US011618776B2

(12) United States Patent
Bernett et al.

(10) Patent No.: US 11,618,776 B2
(45) Date of Patent: Apr. 4, 2023

(54) TARGETED HETERODIMERIC FC FUSION PROTEINS CONTAINING IL-15/IL-15RA AND NKG2D ANTIGEN BINDING DOMAINS

(71) Applicant: Xencor, Inc., Monrovia, CA (US)

(72) Inventors: Matthew J. Bernett, Monrovia, CA (US); John R. Desjarlais, Pasadena, CA (US); Rajat Varma, Monrovia, CA (US); Gregory Moore, Azusa, CA (US); Juan Diaz, Anaheim Hills, CA (US); Alex Nisthal, Monrovia, CA (US); Ke Liu, Glendora, CA (US); Rumana Rashid, Temple City, CA (US); Eric Chang, Walnut, CA (US)

(73) Assignee: Xencor, Inc., Monrovia, CA (US)

( * ) Notice: Subject to any disclaimer, the term of this patent is extended or adjusted under 35 U.S.C. 154(b) by 36 days.

(21) Appl. No.: 16/724,118

(22) Filed: Dec. 20, 2019

(65) Prior Publication Data

US 2020/0247862 A1 Aug. 6, 2020

Related U.S. Application Data

(60) Provisional application No. 62/783,106, filed on Dec. 20, 2018.

(51) Int. Cl.
  *C07K 14/54* (2006.01)
  *C07K 16/28* (2006.01)
  *A61K 38/00* (2006.01)
  *A61K 39/00* (2006.01)
  *A61P 35/00* (2006.01)

(52) U.S. Cl.
  CPC .......... *C07K 14/5443* (2013.01); *A61P 35/00* (2018.01); *C07K 16/2851* (2013.01); *A61K 38/00* (2013.01); *A61K 2039/505* (2013.01); *C07K 2317/622* (2013.01); *C07K 2317/94* (2013.01); *C07K 2319/30* (2013.01)

(58) Field of Classification Search
  CPC combination set(s) only.
  See application file for complete search history.

(56) References Cited

U.S. PATENT DOCUMENTS

| 5,731,168 A | 3/1998 | Carter et al. |
|---|---|---|
| 5,821,333 A | 10/1998 | Carter et al. |
| 6,737,056 B1 | 5/2004 | Presta |
| 7,276,585 B2 | 10/2007 | Lazar et al. |
| 7,355,008 B2 | 4/2008 | Stavenhagen et al. |
| 7,632,497 B2 | 12/2009 | Stavenhagen |
| 7,834,152 B2 | 11/2010 | Strom et al. |
| 7,858,081 B2 | 12/2010 | Bernard et al. |
| 7,960,512 B2 | 6/2011 | Stavenhagen et al. |
| 8,003,774 B2 | 8/2011 | Stavenhagen et al. |
| 8,124,084 B2 | 2/2012 | LeFrancois et al. |
| 8,192,737 B2 | 6/2012 | Stavenhagen et al. |
| 8,216,574 B2 | 7/2012 | Stavenhagen |
| 8,216,805 B2 | 7/2012 | Carter et al. |
| 8,309,690 B2 | 11/2012 | Allan et al. |
| 8,592,562 B2 | 11/2013 | Kannan et al. |
| 8,629,245 B2 | 1/2014 | Georgiou et al. |
| 8,679,493 B2 | 3/2014 | Georgiou et al. |
| 8,742,074 B2 | 6/2014 | Behrens et al. |
| 8,871,912 B2 | 10/2014 | Davis et al. |
| 8,901,283 B2 | 12/2014 | Spee et al. |
| 8,940,288 B2 | 1/2015 | LeFrancois et al. |
| 8,940,289 B2 | 1/2015 | Wong et al. |
| 8,951,517 B2 | 2/2015 | Stavenhagen et al. |
| 9,028,815 B2 | 5/2015 | Stavenhagen et al. |
| 9,150,663 B2 | 10/2015 | Labrijn et al. |
| 9,308,258 B2 | 4/2016 | Kannan et al. |
| RE45,992 E | 5/2016 | Behrens et al. |
| 9,365,630 B2 | 6/2016 | LeFrancois et al. |
| 9,371,368 B2 | 6/2016 | LeFrancois et al. |
| 9,464,127 B2 | 10/2016 | Wong et al. |
| 9,493,533 B2 | 11/2016 | Bernard et al. |
| 9,505,848 B2 | 11/2016 | Davis et al. |
| 9,527,926 B2 | 12/2016 | Ho et al. |
| 9,562,109 B2 | 2/2017 | Von Kreudenstein et al. |
| 9,683,052 B2 | 6/2017 | Blein et al. |
| 9,683,053 B2 | 6/2017 | Blein et al. |
| 9,763,705 B2 | 9/2017 | Faulhaber |
| 9,763,765 B2 | 9/2017 | Horan et al. |
| 9,931,377 B2 | 4/2018 | Pavlakis et al. |
| 9,932,387 B2 | 4/2018 | LeFrancois et al. |
| 9,969,790 B2 | 5/2018 | LeFrancois et al. |
| 10,011,858 B2 | 7/2018 | Igawa et al. |
| 10,138,303 B2 | 11/2018 | Ho et al. |
| 10,350,270 B2 | 7/2019 | McCauley |
| 10,550,185 B2 | 2/2020 | Bernett et al. |

(Continued)

FOREIGN PATENT DOCUMENTS

| EP | 0927254 | 6/2005 |
|---|---|---|
| EP | 3263581 | 1/2008 |
| EP | 1801119 B1 | 6/2009 |
| EP | 1718670 | 7/2011 |
| EP | 1934353 | 10/2011 |

(Continued)

OTHER PUBLICATIONS

Ghasemi et al., Selective targeting of IL-2 to NKG2D bearing cells for improved immunotherapy., Nat. Commun. 7:12878 doi:10.1038/ncomms12878 (2016).

John M Wrangle et al: "ALT-803, an IL-15 superagonist, in combination with nivolumab in patients with metastatic non-small cell lung cancer: a non randomised, open-label, phase lb trial", The Lancet Oncology, vol. 19, No. 5, Apr. 5, 2018 (Apr. 5, 2018), pp. 694-704, XP055605963, DOI: 10.1016/S1470-2045(18)30148-7 abstract, figures 2, 3 table 3.

(Continued)

*Primary Examiner* — Elly-Gerald Stoica
(74) *Attorney, Agent, or Firm* — Kelly A. Plummer; Christopher J. Betti; Morgan, Lewis & Bockius, LLP

(57) ABSTRACT

The present invention is directed to a novel targeted heterodimeric Fc fusion proteins comprising an IL-15/IL-15Rα Fc fusion protein and an NKG2D antigen binding domain Fc fusion proteins.

7 Claims, 241 Drawing Sheets

Specification includes a Sequence Listing.

(56) References Cited

U.S. PATENT DOCUMENTS

| | | |
|---|---|---|
| 2006/0257361 A1 | 11/2006 | Watanabe et al. |
| 2006/0263857 A1 | 11/2006 | LeFrancois et al. |
| 2009/0238791 A1 | 9/2009 | Jacques et al. |
| 2010/0267934 A1 | 10/2010 | Van de Winkel et al. |
| 2011/0054151 A1 | 3/2011 | Lazar et al. |
| 2012/0149876 A1 | 6/2012 | Von Kreudenstein et al. |
| 2012/0177595 A1 | 7/2012 | Wong et al. |
| 2013/0039913 A1 | 2/2013 | Labrijn et al. |
| 2013/0131319 A1 | 5/2013 | Igawa et al. |
| 2013/0178605 A1 | 7/2013 | Blein et al. |
| 2014/0134128 A1 | 5/2014 | Wong et al. |
| 2014/0187753 A1 | 7/2014 | Blein et al. |
| 2014/0199294 A1 | 7/2014 | Mimoto et al. |
| 2014/0288275 A1 | 9/2014 | Moore et al. |
| 2014/0335089 A1 | 11/2014 | Igawa et al. |
| 2014/0356381 A1 | 12/2014 | Moore et al. |
| 2014/0363426 A1 | 12/2014 | Moore et al. |
| 2015/0351275 A1 | 12/2015 | Imbimbo et al. |
| 2016/0068584 A1 | 3/2016 | Bechard et al. |
| 2016/0157951 A1 | 6/2016 | Schoenig et al. |
| 2016/0175459 A1 | 6/2016 | Gey et al. |
| 2016/0184399 A1 | 6/2016 | Bechard et al. |
| 2016/0318986 A1 | 11/2016 | Morisseau et al. |
| 2016/0333067 A1 | 11/2016 | LeFrancois et al. |
| 2016/0347818 A1 | 12/2016 | LeFrancois et al. |
| 2016/0355608 A1 | 12/2016 | Bernett et al. |
| 2016/0367635 A1 | 12/2016 | Wong et al. |
| 2017/0020963 A1 | 1/2017 | Qu et al. |
| 2017/0056874 A1 | 3/2017 | Bechard et al. |
| 2017/0088597 A1 | 3/2017 | Wong et al. |
| 2017/0145078 A1 | 5/2017 | Davis et al. |
| 2017/0151310 A1 | 6/2017 | Felber et al. |
| 2017/0233497 A1 | 8/2017 | Labrijn et al. |
| 2018/0094077 A1 | 4/2018 | Blein et al. |
| 2018/0118805 A1 | 5/2018 | Bernett et al. |
| 2018/0118828 A1 | 5/2018 | Bernett et al. |
| 2018/0118836 A1 | 5/2018 | Bernett et al. |
| 2018/0194860 A1 | 7/2018 | Von Kreudenstein et al. |
| 2018/0200366 A1 | 7/2018 | Wong et al. |
| 2018/0298079 A1 | 10/2018 | LeFrancois et al. |
| 2018/0312560 A1 | 11/2018 | Morisseau et al. |
| 2019/0016778 A1 | 1/2019 | Bernett et al. |
| 2019/0263877 A1 | 8/2019 | Yeung et al. |
| 2020/0247862 A1 | 8/2020 | Bernett et al. |
| 2021/0047407 A1 | 2/2021 | Christian et al. |

FOREIGN PATENT DOCUMENTS

| | | |
|---|---|---|
| EP | 2388266 | 4/2014 |
| EP | 2724728 | 4/2014 |
| EP | 2986312 | 2/2016 |
| EP | 3030262 | 6/2016 |
| EP | 3093295 | 11/2016 |
| EP | 3113858 | 1/2017 |
| EP | 2769984 | 8/2017 |
| EP | 3235830 | 10/2017 |
| EP | 3030575 | 7/2018 |
| EP | 2723869 B1 | 2/2019 |
| EP | 3265478 B1 | 9/2019 |
| EP | 3030262 B1 | 10/2019 |
| EP | 1899364 B1 | 2/2020 |
| WO | WO96027011 | 9/1996 |
| WO | WO1997041232 | 11/1997 |
| WO | WO2001010912 A1 | 2/2001 |
| WO | WO2001071005 | 9/2001 |
| WO | WO2005014642 A2 | 2/2005 |
| WO | WO2005085282 | 9/2005 |
| WO | WO2006063974 | 6/2006 |
| WO | WO2007001677 | 1/2007 |
| WO | WO2007046006 | 4/2007 |
| WO | WO2007084342 | 7/2007 |
| WO | WO2007110205 | 10/2007 |
| WO | WO2007128563 A1 | 11/2007 |
| WO | WO2007147901 | 12/2007 |
| WO | WO2008143794 | 11/2008 |
| WO | WO2009002562 | 12/2008 |
| WO | WO2009036209 | 3/2009 |
| WO | WO2009077483 | 6/2009 |
| WO | WO2009089004 | 7/2009 |
| WO | WO2010017103 | 2/2010 |
| WO | WO2011005621 | 1/2011 |
| WO | WO2011020047 A1 | 2/2011 |
| WO | WO2011063348 | 5/2011 |
| WO | WO2011143545 | 11/2011 |
| WO | WO2011131746 | 12/2011 |
| WO | WO2012032080 | 3/2012 |
| WO | WO2012040323 A2 | 3/2012 |
| WO | WO2012146628 | 11/2012 |
| WO | WO2012131555 | 12/2012 |
| WO | WO2012175222 | 12/2012 |
| WO | WO2013/055809 | 4/2013 |
| WO | WO2013107791 A1 | 7/2013 |
| WO | WO2014079000 | 5/2014 |
| WO | WO2014/110601 | 7/2014 |
| WO | WO2014145806 | 9/2014 |
| WO | WO2014145907 | 9/2014 |
| WO | WO2014170032 | 10/2014 |
| WO | WO2014207173 | 12/2014 |
| WO | WO2015018528 | 2/2015 |
| WO | WO2015018529 | 2/2015 |
| WO | WO2015103928 | 7/2015 |
| WO | WO2015131994 | 9/2015 |
| WO | WO2015195163 | 12/2015 |
| WO | WO2016004060 | 1/2016 |
| WO | WO2016086186 | 6/2016 |
| WO | WO2016086189 A2 | 6/2016 |
| WO | WO2016086196 A2 | 6/2016 |
| WO | WO2016095642 | 6/2016 |
| WO | WO2016106159 | 6/2016 |
| WO | WO2016141387 | 9/2016 |
| WO | WO2016142314 | 9/2016 |
| WO | WO2018007919 A1 | 1/2018 |
| WO | WO2018071918 | 4/2018 |
| WO | WO2018071919 | 4/2018 |
| WO | WO2018091661 | 5/2018 |
| WO | WO2019006472 | 1/2019 |
| WO | WO2019204592 | 10/2019 |
| WO | WO2019204665 | 10/2019 |
| WO | WO2020077276 | 4/2020 |
| WO | WO2020132646 | 6/2020 |

OTHER PUBLICATIONS

Ha et al., Immunoglobulin Fc Heterodimer Platform Technology: From Design to Applications in Therapeutic Antibodies and Proteins., Front Immunol. 2016; 7: 394. Published online Oct. 6, 2016. doi: 10.3389/fimmu.2016.00394.

Rhode et al., Comparison of the Superagonist Complex, ALT-803, to IL15 as Cancer Immunotherapeutics in Animal Models., Cancer Immunol Res. Jan. 2016;4(1):49-60. doi: 10.1158/2326-6066.CIR-15-0093-T. Epub Oct. 28, 2015.

Steinbacher et al., An Fc-optimized NKG2D-immunoglobulin G Fusion Protein for Induction of Natural Killer Cell Reactivity Against Leukemia., Int J Cancer. Mar. 1, 2015;136(5):1073-84. doi: 10.1002/ijc.29083. Epub Jul. 28, 2014.

Prajapati et al., Functions of NKG2D in CD8 + T Cells: An Opportunity for Immunotherapy., Cell Mol Immunol. May 2018;15(5):470-479. doi: 10.1038/cmi.2017.161. Epub Feb. 5, 2018.

U.S. Appl. No. 15/785,401, 2018-0118805, U.S. Pat. No. 10,501,543, Granted, filed Oct. 16, 2017, May 3, 2018, Dec. 10, 2019, Bernett et al.

U.S. Appl. No. 16/660,028, 2020-0040083, Published, filed Oct. 22, 2019, Feb. 6, 2020, Bernett et al.

U.S. Appl. No. 15/785,393, 2018-0118828, U.S. Pat. No. 10,550,185, Granted, filed Oct. 16, 2017, May 3, 2018, Feb. 4, 2020, Bernett et al.

U.S. Appl. No. 16/718,072, 2020-0123259, Published, filed Dec. 17, 2019, Apr. 23, 2020, Bernett et al.

U.S. Appl. No. 16/388,174, 2019-0365861, Allowed, filed Apr. 18, 2019, Dec. 5, 2019, Bernett et al.

(56) References Cited

OTHER PUBLICATIONS

U.S. Appl. No. 16/388,811, 2019-0389933, Published, filed Apr. 18, 2019, Dec. 26, 2019, Bernett et al.
U.S. Appl. No. 16/600,236, 2020-0140512, Published, filed Oct. 11, 2019, May 7, 2020, Bernett et al.
U.S. Appl. No. 16/025,963, 2019-0016778, Published, filed Jul. 2, 2018, Jan. 17, 2019, Bernett et al.
U.S. Appl. No. 16/184,895, 2019-0263909, Published, filed Nov. 8, 2018, Aug. 8, 2019, Bernett et al.
U.S. Appl. No. 16/206,849, 2019-0241638, Published, filed Nov. 30, 2018, Aug. 8, 2019, Bernett et al.
U.S. Appl. No. 16/388,646, 2019-0352362, Published, filed Apr. 18, 2019, Nov. 21, 2019, Bernett et al.
U.S. Appl. No. 16/388,729, 2019-0359684, Published, filed Apr. 18, 2019, Nov. 28, 2019, Bernett et al.
U.S. Appl. No. 16/592,656, 2020-0216509, Published, filed Oct. 3, 2019, Jul. 9, 2020, Bernett et al.
U.S. Appl. No. 16/798,247, Pending, filed Feb. 21, 2020, Moore et al.
U.S. Appl. No. 16/724,118, 2020-0247862, Published, filed Dec. 20, 2019, Aug. 6, 2020, Bernett et al.
U.S. Appl. No. 16/875,878, Pending, filed May 15, 2020, Bernett et al.
U.S. Appl. No. 17/062,458, Pending, filed Oct. 2, 2020, Bernett et al.
U.S. Appl. No. 17/067,508, Pending, filed Oct. 9, 2020, Bernett et al.
Chappel et al., "Identification of a Secondary Fcγ RI Binding Site within a Genetically Engineered Human IgG Actibody," J. Biol. Chem., 268(33):25124-25131 (Nov. 1993).
Chappel et al., "Identification of the Fcγ receptor class I binding site in human IgG through the use of recombinant IgG1/IgG2 hybrid and point-mutated antibodies," PNAS, USA, 88:9036-9040 (Oct. 1991).
Miranda-Carus et al., IL-15 and the initiation of cell contact-dependent synovial fibroblast-T lymphocyte cross-talk in rheumatoid arthritis: effect of methotrexate., 2004 J. Immunol. 13:1463-1476.
Koka et al, Cutting edge: murine dendritic cells require IL-15R alpha to prime NK cells., 2004 J. Immunol. 173:3594-3598.
Matsumoto et al., On-column refolding and characterization of soluble human interleukin-15 receptor alpha-chain produced in *Escherichia coli*., Protein Purification and Expression, 2003 64-71.
Schluns et al., Distinct cell types control lymphoid subset development by means of IL-15 and IL-15 receptor alpha expression., 2004, PNAS 101(5):5616-5621.
Wei et al., The Sushi domain of soluble IL-15 receptor alpha is essential for binding IL-15 and inhibiting inflammatory and allogenic responses in vitro and in vivo., 2001, J. Immunol. 167:277-282.
Han et al., IL-15:IL-15 receptor alpha superagonist complex: high-level co-expression in recombinant mammalian cells, purification and characterization., Cytokine. Dec. 2011;56(3):804-10.
Stone et al., Design and characterization of a protein superagonist of IL-15 fused with IL-15Rα and a high-affinity T cell receptor., Biotechnol Prog. Nov.-Dec. 2012;28(6):1588-97.
Kermer et al., An antibody fusion protein for cancer immunotherapy mimicking IL-15 trans-presentation at the tumor site., Mol Cancer Ther. Jun. 2012;11(6):1279-88.
Kermer et al., Combining Antibody-Directed Presentation of IL-15 and 4-1BBL in a Trifunctional Fusion Protein for Cancer Immunotherapy, Mol Cancer Ther. Jan. 2014;13(1):112-21.
C. Bergamaschi et al, "Intracellular Interaction of Interleukin-15 with Its Receptor during Production Leads to Mutual Stabilization and Increased Bioactivity", 2008, Journal of Biological Chemistry, vol. 283, No. 7, pp. 4189-4199.
Genbank accession No. NM_172174, 1998.
Genbank accession No. NP_002180, Jul. 4, 2020.
S. Dubois et al, "IL-15Rα Recycles and Presents IL-15 In Trans to Neighbouring Cells", Immunity, vol. 17, 537-547.

Y Tagaya et al, "Generation of secretable and non-secretable interleukin-15 isoforms through alternate usage of signal peptides", 1997, Proc. Natl. Acad. Sci. USA, vol. 44, 14444-14449.
Genbank accession No. AF031167.1.
D Anderson et al, "Functional Characterization of the Human IL-15 Receptor α Chain and Close Linkage of IL15RA and IL2RA genes", J. Biol. Chem., vol. 270, No. 50, 29862-29869.
Assignment abstract of title for U.S. Appl. No. 12/666,052.
Mortier E et al, "Natural, Proteolytic Release of a Soluble Form of Human IL-15 Receptor α-Chain That Behaves as a Specific, High Affinity IL-15 Antagonist", J. Immunol 2004; 173: 1681-1688.
Matthew J Bernett et al: Abstract 5565: Potency-reduced IL15/IL15R[alpha] heterodimeric Fc-fusions display enhanced in vivo activity through increased exposure 11 , Cancer Research, vol. 78, No. 13(Suppl)., Apr. 18, 2018 (Apr. 18, 2018), pp. 1-2, XP055658295. abstract.
Kowalsky Stacy Jet al: "Superagonist IL-15-Armed Oncolytic Virus Elicits Potent Antitumor Immunity and Therapy That Are Enhanced with PD-1 Blockade", Molecular Therapy, Nature Publishing Group, GB, vol. 26, No. 10, Oct. 3, 2018 (Oct. 3, 2018), pp. 2476-2486, XP002794091, ISSN: 1525-0024, DOI: 10.1016/J.YMTHE.2018.07.013 abstract, figures 5 and 6.
Wells, Additivity of mutational effects in proteins., Biochemistry 1990, 29, 37, 8509-8517.
Bork, Powers and Pitfalls in Sequence Analysis: The 70% Hurdle., Genome Res. 2000. 10: 398-400.
Skolnick et al., From Genes to Protein Structure and Function: Novel Applications of Computational Approaches in the Genomic Era., Trends Biotechnol. Jan. 2000;18(1):34-9.
Doerks et al., Protein annotation: detective work for function prediction., Trends in Genetics, 1998 vol. 14, Issue 6, p. 248-250, Jun. 1, 1998.
Tokuriki et al., Stability effects of mutations and protein evolvability., Current Opinion in Structural Biology 2009, 19: 596-604.
Fabbi et al, Dual Roles of IL-15 in Cancer Biology, Journal of Cytokine Biology, 2016, vol. 1, No. 2, pp. 1-7.
Mathios et al, Therapeutic administration of IL-15 superagonist complex ALT-803 leads to long-term survival and durable antitumor immune response in a murine glioblastoma model., International Journal of Cancer, 2016; vol. 138, pp. 187-194.
Alter et al., Targeted IL-15-based Protein Fusion Complexes as Cancer Immunotherapy Approaches., J Immunological Sci. (2018); 2(1): 15-18.
Bailey et al., New interleukin-15 superagonist (IL-15SA) significantly enhances graft-versus-tumor activity., Oncotarget. Jul. 4, 2017; 8(27): 44366-44378.
Charych et al., NKTR-214, an Engineered Cytokine with Biased IL2 Receptor Binding, Increased Tumor Exposure, and Marked Efficacy in Mouse Tumor Models., Clin Cancer Res; 22(3) Feb. 1, 2016.
Chen et al., A targeted IL-15 fusion protein with potent antitumor activity., (2015) Cancer Biology & Therapy, 16:9, 1415-1421, DOI: 10.1080/15384047.2015.1071739.
Jochems et al., The multi-functionality of N-809, a novel fusion protein encompassing anti-PD-L1 and the IL-15 superagonist fusion complex., OncoImmunology, 2019, vol. 8, No. 2, e1532764 (15 pages).
Klein et al., Cergutuzumab amunaleukin (CEA-IL2v), a CEAtargeted IL-2 variant-based immunocytokine for combination cancer immunotherapy: Overcoming limitations of aldesleukin and conventional IL-2-based immunocytokines.,(2017) OncoImmunology, 6:3, e1277306, DOI: 10.1080/2162402X.2016.1277306.
Olsen et al., Crystal Structure of the Interleukin-15 * Interleukin-15 Receptor α Complex., The Journal of Biological Chemistry vol. 282, No. 51, pp. 37191-37204, Dec. 21, 2007.
Vallera et al., IL15 Trispecific Killer Engagers (TriKE) Make Natural Killer Cells Specific to CD33p Targets While Also Inducing Persistence, In Vivo Expansion, and Enhanced Function., Clin Cancer Res; 22(14) Jul. 15, 2016.
Xu et al., Efficacy and Mechanism-of-Action of a Novel Superagonist Interleukin-15: Interleukin-15 Receptor α Su/Fc Fusion Complex in Syngeneic Murine Models of Multiple Myeloma., Cancer Res. May 15, 2013;73(10):3075-86.

(56) References Cited

OTHER PUBLICATIONS

Zhu et al., Novel Human Interleukin-15 Agonists., The Journal of Immunology; 2009; vol. 183, No. 6; pp. 1-28.
Bernard et al., Identification of an Interleukin-15α Receptor-binding Site on Human Interleukin-15*., The Journal of Biological Chemistry; 2004; vol. 279, No. 23, pp. 24313-24322.
Robinson et al., The potential and promise of IL-15 in immuno-oncogenic therapies, Immunology Letters, vol. 190, 2017, pp. 159-168.
Schmid et al., Design and characterisation of a novel interleukin-15 receptor alpha fusion protein and analysis of interleukin-15 complexation., PLoS One. Jul. 26, 2019;14(7):e0219313.
Genbank accession No. U31628, Dec. 19, 1995.
Muller, Dafne, Targeted cancer immunotherapy, Mimicking physiological trans-presentation of IL-15., Oncoimmunology. Oct. 1, 2012; 1(7): 1213-1214.
Garcin et al. High efficiency cell-specific targeting of cytokine activity. Nat Commun 5, 3016 (2014).
Kaspar et al, The antibody-mediated targeted delivery of interleukin-15 and GM-CSF to the tumor neovasculature inhibits tumor growth and metastasis., Cancer Res. May 15, 2007;67(10):4940-8.
Conlon et al., Redistribution, hyperproliferation, activation of natural killer cells and CD8 T cells, and cytokine production during first-in-human clinical trial of recombinant human interleukin-15 in patients with cancer., J Clin Oncol. Jan. 1, 2015;33(1):74-82.
List et al., Immunocytokines: a review of molecules in clinical development for cancer therapy., Clin Pharmacol. 2013; 5(Suppl 1): 29-45.
Gillies et al., Antibody-targeted interleukin 2 stimulates T-cell killing of autologous tumor cells., PNAS Feb. 15, 1992 89 (4) 1428-1432.
Albertini et al. Phase II trial of hu14.18-IL2 for patients with metastatic melanoma., Cancer Immunol Immunother. Dec. 2012;61(12):2261-71.
Ribas et al., Phase I/II open-label study of the biologic effects of the interleukin-2 immunocytokine EMD 273063 (hu14.18-IL2) in patients with metastatic malignant melanoma., J Transl Med. Jul. 29, 2009;7:68.
Hofmann et al., Generation, selection and preclinical characterization of an Fc-optimized FLT3 antibody for the treatment of myeloid leukemia., Leukemia. Jun. 2012;26(6):1228-37.
Kellner et al., Heterodimeric bispecific antibody-derivatives against CD19 and CD16 induce effective antibody-dependent cellular cytotoxicity against B-lymphoid tumor cells., Cancer Lett. Apr. 28, 2011;303(2):128-39.
Skera, Arne, 'Anticalins': a new class of engineered ligand-binding proteins with antibody-like properties., J Biotechnol. Jun. 2001;74(4):257-75.
Skera, Arne, Engineered protein scaffolds for molecular recognition., J Mol Recognit. Jul.-Aug. 2000;13(4):167-87.
Horton et al. Potent in vitro and in vivo activity of an Fc-engineered anti-CD19 monoclonal antibody against lymphoma and leukemia., Cancer Res, 2008, vol. 68, 8049-8057.
Ortiz-Sánchez et al., Antibody-cytokine fusion proteins: applications in cancer therapy., Expert Opin Biol Ther. May 2008 ; 8(5): 609-632.
Zhu et al., Novel Human Interleukin-15 Agonists., J Immunol Sep. 15, 2009, 183 (6) 3598-3607.
Xia et al., In vivo effect of recombined IL-15/Fc fusion protein on EAU. Sichuan Da Xue Xue Bao Yi Xue Ban. Nov. 2008;39(6) 944-949.
Wu et al., IL-15Rα-IgG1-Fc Enhances IL-2 and IL-15 Anti-tumor Action through NK and CD8+ T Cells Proliferation and Activation., Journal of Molecular Cell Biology, vol. 2, Issue 4, Aug. 2010, pp. 217-222.
Ridgway et al., 'Knobs-into-holes' engineering of antibody CH3 domains for heavy chain heterodimerization., Protein Engineering, Design and Selection, vol. 9, Issue 7, Jul. 1996, pp. 617-621.
Carter P. Bispecific human IgG by design. J Immunol Methods. Feb. 1, 2001;248(1-2):7-15. doi: 10.1016/s0022-1759(00)00339-2. PMID: 11223065.

Atwell et al., Stable heterodimers from remodeling the domain interface of a homodimer using a phage display library 1 .,Journal of Molecular Biology, vol. 270, Issue 1,1997,pp. 26-35, ISSN 0022-2836, https://doi.org/10.1006/jmbi.1997.1116.
Merchant, et al., An efficient route to human bispecific IgG, Nature Biotechnology, 1998, vol. 16, pp. 677-681.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Deshpande et al., (2013), Kinetic analysis of cytokine-mediated receptor assembly using engineered FC heterodimers. Protein Science, 22: 1100-1108. https://doi.org/10.1002/pro.2285.
Dumont et al. Monomeric Fc Fusions. BioDrugs 20, 151-160 (2006). https://doi.org/10.2165/00063030-200620030-00002.
Belladonna et al., (2013) Bioengineering heterodimeric cytokines: turning promiscuous proteins into therapeutic agents, Biotechnology and Genetic Engineering Reviews, 29:2, 149-174, DOI: 10.1080/02648725.2013.801228.
Hinrichs, Christian S., Can interleukin-15 keep its therapeutic promise? Science Translational Medicine Mar. 7, 2018:vol. 10, Issue 431, eaar7532, DOI: 10.1126/scitranslmed.aar7532.
Rubinstein et al., Converting IL-15 to a superagonist by binding to soluble IL-15R{alpha}. Proc Natl Acad Sci U S A. Jun. 13, 2006;103(24):9166-71. doi: 10.1073/pnas.0600240103. Epub Jun. 6, 2006. PMID: 16757567; PMCID: PMC1482584.
Stoklasek et al., Combined IL-15/IL-15Ralpha immunotherapy maximizes IL-15 activity in vivo. J Immunol. Nov. 1, 2006;177(9):6072-80. doi: 10.4049/jimmunol.177.9.6072. PMID: 17056533; PMCID: PMC2847275.
Landolfi NF. A chimeric IL-2/Ig molecule possesses the functional activity of both proteins. J Immunol. Feb. 1, 1991;146(3):915-9. PMID: 1988502.
Zheng et al., Administration of noncytolytic IL-10/Fc in murine models of lipopolysaccharide-induced septic shock and allogeneic islet transplantation., J Immunol May 15, 1995, 154 (10) 5590-5600.
Low, et al., Oral and pulmonary delivery of FSH-Fc fusion proteins via neonatal Fc receptor-mediated transcytosis, Human Reproduction, vol. 20, Issue 7, Jul. 2005, pp. 1805-1813.
Kim et al., Targeting the IL-15 Receptor with an Antagonist IL-15 Mutant/Fcγ2a Protein Blocks Delayed-Type Hypersensitivity., J Immunol Jun. 15, 1998, 160 (12) 5742-5748.
Larrick et al., 2013, Inflammation, Advancing Age and Nutrition. D26 Chapter 28. Trophokines: Novel Therapy for Senescence-Related Fibrosis htto://dx rlo1.ora/10 1016/B978-0-12-397803-5. 00028-9.
Mortier et al., Soluble interleukin-15 receptor alpha (IL-15R alpha)-sushi as a selective and potent agonist of IL-15 action through IL-15R beta/gamma. Hyperagonist IL-15 x IL-15R alpha fusion proteins. J Biol Chem. Jan. 20, 2006;281(3):1612-9. doi: 10.1074/jbc.M508624200. Epub Nov. 11, 2005. PMID: 16284400.
Wu J. IL-15 Agonists: The Cancer Cure Cytokine. J Mol Genet Med. Oct. 28, 2013;7:85. doi: 10.4172/1747-0862.1000085. PMID: 24587813; PMCID: PMC3938108.
C. Spiess et al., J. Biol. 288(37):26583-93 (2013), Development of a D30 Human IgG4 Bispecific Antibody for Dual Targeting of Interleukin-4 (IL-4) and Interleukin-13 (IL-13) Cytokines.
Hopp et al. 1988. "A Short Polypeptide Marker Sequence Useful for Recombinant Protein Identification and Purification" Nat. Biotechnol. 6, 1204-1210.
Budagian et al., IL-15/IL-15 receptor biology: a guided tour through an expanding universe., Cytokine Growth Factor Rev. Aug. 2006;17(4):259-8.
Bodnar et al., A biophysical approach to IL-2 and IL-15 receptor function: Localization, conformation and interactions., Immunology Letters 116 (2008) 117-125.
Numerof et al., Cytokines as Potential Therapeutic Targets for Inflammatory Skin Diseases., Springer-Verlag, Berlin Heidelberg 2006.
Dumont, Francis J. (2005) Interleukin-2 family cytokines: potential for therapeutic immmunoregulation, Expert Opinion on Therapeutic Patents, 15:5, 521-554.

(56) References Cited

OTHER PUBLICATIONS

Savio et al., IL-15: a relevant cytolcine for lymphoid homeostasis and autoimmune diseases., Biotecnologia Ap/icada 2006;23:87-93.
Lichtenegger et al., Targeting LAG-3 and PD-1 to Enhance T Cell Activation by Antigen-Presenting Cells., Front. Immunol. Feb. 27, 2018; 9: 385; pp. 1-12.
Guo et al., Immunobiology of the IL-15/IL-15Rα complex as an antitumor and antiviral agent., Cytokine Growth Factor Rev. Dec. 2017; 38: 10-21.
Ng et al., Heterodimeric IL15 Treatment Enhances Tumor Infiltration, Persistence, and Effector Functions of Adoptively Transferred Tumor-specific T Cells in the Absence of Lymphodepletion., Clin. Cancer Res. Jun. 2017; 23 (11): 2817-30.
Liang et al., Targeting IFNα to tumor by anti-PD-L1 creates feedforward antitumor responses to overcome checkpoint blockade resistance ., Nat. Commun. Nov. 2, 2018; 9 (1): 4586.
Chen et al., Therapeutic efficacy of an anti-PD-L1 antibody based immunocytokine in a metastatic mouse model of colorectal cancer ., Biochem. Biophys. Res. Commun. Nov. 11, 2016; 480 (2): 160-5.
Kiefer et al., Immunocytokines and bispecific antibodies: two complementary strategies for the selective activation of immune cells at the tumor site., Immunol. Rev. Mar. 2016; 270 (1): 178-92; author manuscript; pp. 1-27.
Sondel et al., Current and Potential Uses of Immunocytokines as Cancer Immunotherapy., Antibodies. 212; 1: 149-71.
Kim et al., IL-15 superagonist/IL-15RαSushi-Fc fusion complex (IL-15SA/IL-15RαSu-Fc; ALT-803) markedly enhances specific subpopulations of NK and memory CD8+ T cells, and mediates potent anti-tumor activity against murine breast and colon carcinomas., Oncotarget. Mar. 29, 2016; 7 (13): 16130-45.
Rogers et al., Molecular characterization of immunoglobulin D in mammals: immunoglobulin heavy constant delta genes in dogs, chimpanzees and four old world monkey species., Immunology. May 2006; 118 (1): 88-100.
Rowley J. et al., Inhibition of tumor growth by NK1. 1+ cells and CD8+ T cells activated by IL-15 through receptor β/common γ signaling in trans, The Journal of Immunology, 2008, V. 181, N. 12, p. 8237-8247, p. 8237.
Shen J. et al., Single variable domain-IgG fusion: a novel recombinant approach to Fc domain-containing bispecific antibodies, Journal of Biological Chemistry, 2006, V. 281, N. 16, p. 10706-10714, p. 10713.
Chen X. et al., Fusion protein linkers: property, design and functionality, Advanced drug delivery reviews, 2013, V. 65, N. 10, p. 1357-1369, the whole text, p. 1365.
Maeda Y. et al., Engineering of functional chimeric protein G-VargulaLuciferase, Analytical biochemistry, 1997, V. 249, N. 2, p. 147-152, the whole text, p. 148, p. 151.
Gasser B. et al., Antibody production with yeasts and filamentous fungi: on the road to large scale? Biotechnology letters, 2007, V. 29, N. 2, p. 201-212, p. 208.

An Z., Therapeutic monoclonal antibodies: from bench to clinic, John Wiley And Sons, 2011, 896 p., p. 350.
Burns W. R. et al., A high molecular weight melanoma-associated antigen-specific chimeric antigen receptor redirects lymphocytes to target human melanomas, Cancer research, 2010, V. 70, N. 8, p. 3027-3033, p. 3028.
Colman P. M., Effects of amino acid sequence changes on antibody-antigen interactions, Research in Immunology, 1994, V. 145, N. 1, p. 33-36, c.33.
Safdari Y. et al., Antibody humanization methods—a review and update, Biotechnology and Genetic Engineering Reviews, 2013, V. 29, N. 2, p. 175-186, p. 178, 180.
Teplyakov A. et al., Antibody modeling assessment II. Structures and models, Proteins: Structure, Function, and Bioinformatics, 2014, V. 82, N. 8, p. 1563-1582, the whole text, p. 1582).
Yu et al. Simultaneous blockade of multiple immune system inhibitory checkpoints enhances antitumor activity mediated by interleukin-15 in a murine metastatic colon carcinoma model. Clin Cancer Res. 2010;16(24):6019-6028.
Vincent et al. Tumor targeting of the IL-15 superagonist RLI by an anti-GD2 antibody strongly enhances its antitumor potency. Int J Cancer. 2013;133(3):757-765.
Vincent et al. CS14-6. Development of two IL15 immunocytokines targeting either GD2- or CD20-tumoral bearing cells. Cytokine. 2011;56 (1):102.
Xu et al. The tumor immunosuppressive microenvironment impairs the therapy of anti-HER2/neu antibody. Protein Cell. 2012;3(6):441-449.
Bessard et al. High antitumor activity of RLI, an interleukin-15 (IL-15)-IL-15 receptor alpha fusion protein, in metastatic melanoma and colorectal cancer. Mol Cancer Ther. 2009;8(9):2736-2745.
Yu et al., "Simultaneous inhibition of two regulatory T-cell subsets enhanced Interleukin-15 efficacy in a prostate tumor model.", Proc Natl Acad Sci USA. 2012;109(16):6187-6192.
Perdreau et al. "Different dynamics of IL-15R activation following IL-15 cis- or trans-presentation." Eur Cytokine Netw. Dec. 2010;21(4):297-307.
Desbois et al. "IL-15 Trans-Signaling with the Superagonist RLI Promotes Effector/Memory CD8+ T Cell Responses and Enhances Antitumor Activity of PD-1 Antagonists.", J Immunol. Jul. 1, 2016;197(1):168-78. doi: 10.4049/jimmunol.1600019. Epub May 23, 2016.
Intlekofer et al., "At the Bench: Preclinical rationale for CTLA-4 and PD-1 blockade as cancer immunotherapy", Journal of Leukocyte Biology, vol. 94, Jul. 2013.
Melero et al.: "Evolving synergistic combinations of targeted immunotherapies to combat cancer", Nature Reviews, Cancer, vol. 15, 2015.
Waldmann: "The biology of interleukin-2 and interleukin-15: implications for cancer therapy and vaccine design", 2006, Nat Rev Immunol 6(8): 595-601.
Dubois et al., Preassociation of IL-15 with IL-15Rα-IgG1-Fc Enhances Its Activity on Proliferation of NK and CD8+/CD44high T Cells and Its Antitumor Action., J Immunol Feb. 15, 2008, 180 (4) 2099-2106; DOI: https://doi.org/10.4049/jimmunol.180.4.2099.

Figure 1A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 1B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 1C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 1D

| Monomer 1 | Monomer 2 |
| --- | --- |
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 1E

| Monomer 1 | Monomer 2 |
| --- | --- |
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| K247Q/R355Q/N384S/K392N/V397M/Q419E/K447_ | P217R/P228R/N276K |
| K247Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| K247Q/R355Q/Q419E/K447_ | P217R/P228R/N276K |
| K247Q/R355Q/Q419E/K447_ | N276K |
| I199T/N203D/K274Q/R355Q/N384S/K392N/V397M/Q419E/K447_ | |
| N208D/Q295E/N384D/Q418E/N421D | |
| N208D/Q295E/Q418E/N421D | |
| Q196K/I199T/P217R/P228R/N276K | |
| Q196K/I199T/N276K | |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 2

| Variant constant region | Substitutions |
|---|---|
| pI_ISO(-) | I199T/N203D/K274Q/R355Q/N384S/K392N/V397M/Q419E/K447_ |
| pI_ISO(-)-Fc only | K274Q/R355Q/N384S/K392N/V397M/Q419E/K447_ |
| pI_(-)_isosteric A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 3

Ablation Variants
G236R
S239G
S239K
S239Q
S239R
V266D
S267K
S267R
H268K
E269R
299R
299K
K322A
A327G
A327L
A327N
A327Q
L328E
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figure 4A

| IL-15-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 4B

| scIL-15/Rα-Fc monomer (-) | empty-Fc monomer (+) |
|---|---|
| C220S | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 4C

| empty-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 4D

| IL-15Rα(sushi)-Fc Chain 1 | IL-15Rα(sushi)-Fc Chain 2 |
|---|---|
| C220S | C220S |
| FcKO | FcKO |
| ±M428L/N434S | ±M428L/N434S |

Figure 4E

| Fc-IL-15Rα(sushi) (-) | IL-15Rα(sushi)-Fc monomer (+) |
|---|---|
| C220S | C220S |
| Heterodimer pI variants L368D/K370S | Heterodimer pI variants S364K/E357Q |
| | Isosteric pI substitutions P217R/P228R/N276K |
| FcKO | FcKO |
| ±M428L/N434S | ±M428L/N434S |

Figure 5A

| scIL-15/Rα-Fc monomer (-) | scFv-Fc monomer (+) |
|---|---|
| C220S | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 5B

| scFv-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 5C

| scIL-15/Rα-Fc monomer (-) | Heavy Chain (+) |
|---|---|
| C220S | |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 5D

| Heavy Chain (-) | IL-15Rα(sushi)-Fc monomer (+) |
|---|---|
| | C220S |
| Heterodimer pI variants L368D/K370S | Heterodimer pI variants S364K/E357Q |
| Isosteric pI substitutions | |
| FcKO | FcKO |
| ±M428L/N434S | ±M428L/N434S |

Figure 5E

| Heavy Chain-IL-15Rα(sushi) (-) | Heavy Chain (+) |
|---|---|
| Heterodimer pI variants L368D/K370S | Heterodimer pI variants S364K/E357Q |
| Isosteric pI substitutions | Isosteric pI subsitutions |
| FcKO | FcKO |
| ±M428L/N434S | ±M428L/N434S |

Figure 5F

| Heavy Chain (-) | Heavy Chain-IL-15Rα(sushi) (+) |
|---|---|
| Heterodimer pI variants L368D/K370S | Heterodimer pI variants S364K/E357Q |
| Isosteric pI subsitutions | Isosteric pI subsitutions |
| FcKO | FcKO |
| ±M428L/N434S | ±M428L/N434S |

Figure 6

| Name | Sequence | SEQ ID NO: |
|---|---|---|
| (GGGGS)$_1$ or GGGGS | GGGGS | 11 |
| (GGGGS)$_2$ | GGGGSGGGGS | 12 |
| (GGGGS)$_3$ | GGGGSGGGGSGGGGS | 13 |
| (GGGGS)$_4$ | GGGGSGGGGSGGGGSGGGGS | 14 |
| (GGGGS)$_5$ | GGGGSGGGGSGGGGSGGGGSGGGGS | 15 |
| (GGGGS)$_6$ | GGGGSGGGGSGGGGSGGGGSGGGGSGGGGS | 16 |
| (GGGGS)$_7$ | GGGGSGGGGSGGGGSGGGGSGGGGSGGGGSGGGGS | 17 |
| 30AA-linker | DPALVHQRPAPPGGGSGGGGSGGGGSGGG | 18 |
| (GKPGS)$_1$ or GKPGS | GKPGS | 19 |
| (GKPGS)$_5$ | GKPGSGKPGSGKPGSGKPGSGKPGS | 20 |
| (GKPGS)$_6$ | GKPGSGKPGSGKPGSGKPGSGKPGSGKPGS | 21 |
| (GGGES)$_1$ or GGGES | GGGES | 22 |

Figure 7

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | 13 |
| Whitlow linker | GSTSGSGKPGSGEGSTKG | 18 | +1 | 23 |
| 6paxA_1 (+A) | IRPRAIGGSKPRVA | 14 | +4 | 24 |
| +B | GKGGSGKGGSGKGGS | 15 | +3 | 25 |
| +C | GGKGSGGKGSGGKGS | 15 | +3 | 26 |
| +D | GGGKSGGGKSGGGKS | 15 | +3 | 27 |
| +E | GKGKSGKGKSGKGKS | 15 | +6 | 28 |
| +F | GGGKSGGKGSGKGGS | 15 | +3 | 29 |
| +G | GKPGSGKPGSGKPGS | 15 | +3 | 30 |
| +H | GKPGSGKPGSGKPGSGKPGS | 20 | +4 | 31 |
| +I | GKGKSGKGKSGKGKSGKGKS | 20 | +8 | 32 |

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | 14 |
| 3hsc_2 (-A) | STAGDTHLGGEDFD | 14 | -4 | 33 |
| -B | GEGGSGEGGSGEGGS | 15 | -3 | 34 |
| -C | GGEGSGGEGSGGEGS | 15 | -3 | 35 |
| -D | GGGESGGGESGGGES | 15 | -3 | 36 |
| -E | GEGESGEGESGEGES | 15 | -6 | 37 |
| -F | GGGESGGEGSGEGGS | 15 | -3 | 38 |
| -G | GEGESGEGESGEGESGEGES | 20 | -8 | 39 |

Additional scFv Linkers

| Sequence | SEQ ID NO: |
|---|---|
| GGGGSGGGGSGGGGS | SEQ ID NO: 13 |
| GGGGSGGGGSGGGGSGGGGS | SEQ ID NO: 14 |
| GSTSGSGKPGSGEGSTKG | SEQ ID NO: 23 |
| PRGASKSGSASQTGSAPGS | SEQ ID NO: 40 |
| GTAAAGAGAAGGAAAGAAG | SEQ ID NO: 41 |
| GTSGSSGSGSGGSGSGGGG | SEQ ID NO: 42 |
| GKPGSGKPGSGKPGSGKPGS | SEQ ID NO: 31 |

Figure 8A

IL-15/Rα-Fc Backbone 1

>IL-15/Rα-Fc monomer 1 (SEQ ID NO: 43)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO: 44)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 2

>IL-15/Rα-Fc monomer 1 (SEQ ID NO: 45)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO: 46)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 3

>IL-15/Rα-Fc monomer 1 (SEQ ID NO: 47)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO: 48)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CEVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 4

>IL-15/Rα-Fc monomer 1 (SEQ ID NO: 49)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSKGSFFLYSKLTVDKSRWQQGNVFSCSVMHEALHNHYTQKSL
SLSPGK >IL-15/Rα-Fc monomer 2 (SEQ ID NO: 50)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTENEVSLT
CLVKGFYPSDIAVEWESDGQPENNYKTTPPVLDSDGSFFLYSKLEVDKSRWEQGDVFSCSVMHEALHNHYTQKSL
SLSPGK

Figure 8B

<u>IL-15/Rα-Fc Backbone 5</u>

>IL-15/Rα-Fc monomer 1 (SEQ ID NO: 51)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSRDQLTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO: 52)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSRDELTKNQVSLT
CDVSGFYPSDIAVEWESDGQPENNYKTTPPVLDSDGSFFLYSKLTVDKSRWEQGDVFSCSVMHEALHNHYTQKSL
SLSPGK <u>IL-15/Rα-Fc Backbone 6</u>

>IL-15/Rα-Fc monomer 1 (SEQ ID NO: 53)
EPKSSDKTHTCPPCPAPPVAGPSVFLFPPKPKDTLMISRTPEVTCVVVDVKHEDPEVKFNWYVDGVEVHNAKTKP
REEQYASTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO: 54)
EPKSSDKTHTCPPCPAPPVAGPSVFLFPPKPKDTLMISRTPEVTCVVVDVKHEDPEVKFNWYVDGVEVHNAKTKP
REEEYASTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK <u>IL-15/Rα-Fc Backbone 7</u>

>IL-15/Rα-Fc monomer 1 (SEQ ID NO: 55)
EPKSSDKTHTCPPCPAPPVAGPSVFLFPPKPKDTLMISRTPEVTCVVVDVKHEDPEVKFNWYVDGVEVHNAKTKP
REEQYSSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO: 56)
EPKSSDKTHTCPPCPAPPVAGPSVFLFPPKPKDTLMISRTPEVTCVVVDVKHEDPEVKFNWYVDGVEVHNAKTKP
REEEYSSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK <u>IL-15/Rα-Fc Backbone 8</u>

>IL-15/Rα-Fc monomer 1 (SEQ ID NO: 57)
ESKYGPPCPPCPAPEFLGGPSVFLFPPKPKDTLMISRTPEVTCVVVDVSQEDPEVQFNWYVDGVEVHNAKTKPRE
EQFNSTYRVVSVLTVLHQDWLNGKEYKCKVSNKGLPSSIEKTISKAKGQPREPQVYTLPPSQEQMTKNQVKLTCL
VKGFYPSDIAVEWESNGQPENNYKTTPPVLDSDGSFFLYSRLTVDKSRWQEGNVFSCSVMHEALHNHYTQKSLSL
SLGK >IL-15/Rα-Fc monomer 2 (SEQ ID NO: 58)
ESKYGPPCPPCPAPEFLGGPSVFLFPPKPKDTLMISRTPEVTCVVVDVSQEDPEVQFNWYVDGVEVHNAKTKPRE
EEFNSTYRVVSVLTVLHQDWLNGKEYKCKVSNKGLPSSIEKTISKAKGQPREPQVYTLPPSQEEMTKNQVSLTCD
VSGFYPSDIAVEWESDGQPENNYKTTPPVLDSDGSFFLYSRLTVDKSRWEEGDVFSCSVMHEALHNHYTQKSLSL
SLGK

Figure 8C

IL-15/Rα-Fc Backbone 9

\>IL-15/Rα-Fc monomer 1 (SEQ ID NO: 59)
ERKCCVECPPCPAPPVAGPSVFLFPPKPKDTLMISRTPEVTCVVVDVSHEDPEVQFNWYVDGVEVHNAKTKPREE
QFNSTFRVVSVLTVVHQDWLNGKEYKCKVSNKGLPAPIEKTISKTKGQPREPQVYTLPPSREQMTKNQVKLTCLV
KGFYPSDIAVEWESNGQPENNYKTTPPMLDSDGSFFLYSKLTVDKSRWQQGNVFSCSVMHEALHNHYTQKSLSLS
PGK \>IL-15/Rα-Fc monomer 2 (SEQ ID NO: 60)
ERKCCVECPPCPAPPVAGPSVFLFPPKPKDTLMISRTPEVTCVVVDVSHEDPEVQFNWYVDGVEVHNAKTKPREE
EFNSTFRVVSVLTVVHQDWLNGKEYKCKVSNKGLPAPIEKTISKTKGQPREPQVYTLPPSREEMTKNQVSLTCDV
SGFYPSDIAVEWESDGQPENNYKTTPPMLDSDGSFFLYSKLTVDKSRWEQGDVFSCSVMHEALHNHYTQKSLSLS
PGK

IL-15/Rα-Fc Backbone 10

\>IL-15/Rα-Fc monomer 1 (SEQ ID NO: 61)
ERKCCVECPPCPAPPVAGPSVFLFPPKPKDTLMISRTPEVTCVVVDVKHEDPEVQFNWYVDGVEVHNAKTKPREE
QFNSTFRVVSVLTVVHQDWLNGKEYKCKVSNKGLPAPIEKTISKTKGQPREPQVYTLPPSREQMTKNQVKLTCLV
KGFYPSDIAVEWESNGQPENNYKTTPPMLDSDGSFFLYSKLTVDKSRWQQGNVFSCSVMHEALHNHYTQKSLSLS
PGK \>IL-15/Rα-Fc monomer 2 (SEQ ID NO: 62)
ERKCCVECPPCPAPPVAGPSVFLFPPKPKDTLMISRTPEVTCVVVDVKHEDPEVQFNWYVDGVEVHNAKTKPREE
EFNSTFRVVSVLTVVHQDWLNGKEYKCKVSNKGLPAPIEKTISKTKGQPREPQVYTLPPSREEMTKNQVSLTCDV
SGFYPSDIAVEWESDGQPENNYKTTPPMLDSDGSFFLYSKLTVDKSRWEQGDVFSCSVMHEALHNHYTQKSLSLS
PGK

IL-15/Rα-Fc Backbone 11

\>IL-15/Rα-Fc monomer 1 (SEQ ID NO: 63)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVLHEALHSHYTQKSL
SLSPGK \>IL-15/Rα-Fc monomer 2 (SEQ ID NO: 64)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVLHEALHSHYTQKSL
SLSPGK

IL-15/Rα-Fc Backbone 12

\>IL-15/Rα-Fc monomer 1 (SEQ ID NO: 65)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQKSL
SLSPGK \>IL-15/Rα-Fc monomer 2 (SEQ ID NO: 66)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQKSL
SLSPGK

Figure 8D

<u>IL-15/Rα-Fc Backbone 13</u>

>IL-15/Rα-Fc monomer 1 (SEQ ID NO: 67)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK >IL-15/Rα-Fc monomer 2 (SEQ ID NO: 68)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 9

IL-15/Rα x anti-CD8 Backbone 1

Chain 1 (SEQ ID NO: 69)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
NTKVDKKVEPKSCDKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK

Chain 2 (SEQ ID NO: 70)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

IL-15/Rα x anti-CD8 Backbone 2

Chain 1 (SEQ ID NO: 71)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
DTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK

Chain 2 (SEQ ID NO: 72)
EPKSSDKTHTCPPCPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVMHEALHNHYTQKSLSLSPGK

IL-15/Rα x anti-CD8 Backbone 3

Chain 1 (SEQ ID NO: 73)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
DTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK

Chain 2 (SEQ ID NO: 74)
ASTKGPSVFPLAPSSKSTSGGTAALGCLVKDYFPEPVTVSWNSGALTSGVHTFPAVLQSSGLYSLSSVVTVPSSSLGTKTYICNVNHKPS
NTKVDKKVERKSCDKTHTCPRCPAPPVAGPSVFLFPPKPKDTLMISRTPEVTCVVVDVKHEDPEVKFKWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK

Figure 10

Constant Light Chain – Kappa (SEQ ID NO: 75)
RTVAAPSVFIFPPSDEQLKSGTASVVCLLNNFYPREAKVQWKVDNALQSGNSQESVTEQDSKDSTYSLSSTLTLSKADYEKHKVYACEVT
HQGLSSPVTKSFNRGEC

Constant Light Chain – Lambda (SEQ ID NO: 76)
GQPKAAPSVTLFPPSSEELQANKATLVCLISDFYPGAVTVAWKADSSPVKAGVETTTPSKQSNNKYAASSYLSLT
PEQWKSHRSYSCQVTHEGSTVEKTVAPTECS

Figure 11

>XENP15074 Numax_IgG1_PVA_/S267K

XENP15074 Heavy Chain (SEQ ID NO: 847)
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK

XENP15074 Light Chain (SEQ ID NO: 848)
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

Figure 12

>XENP16432 Nivolumab_H0L0_IgG1_PVA_/S267K
XENP16432 Heavy Chain (SEQ ID NO: 849)
QVQLVESGGGVVQPGRSLRLDCKASGITFS<u>NSGMH</u>WVRQAPGKGLEWVA<u>VIWYDGSKRYYADSVKG</u>RFTISRDNS
KNTLFLQMNSLRAEDTAVYYCAT<u>NDDY</u>WGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAV
EWESNGQPENNYKTTPPVLDSDGSFFLYSKLTVDKSRWQQGNVFSCSVMHEALHNHYTQKSLSLSPGK XENP16432 Light Chain (SEQ ID NO: 850)
EIVLTQSPATLSLSPGERATLSC<u>RASQSVSSYLA</u>WYQQKPGQAPRLLIY<u>DASNRAT</u>GIPARFSGSGSGTDFTLTI
SSLEPEDFAVYYC<u>QQSSNWPRT</u>FGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 13

**>XENP26007 human_IL15Ra(sushi)_(GGGGS)5-human_IL15(N4D/N65D;single-Chain
)-Numax_IgG1_Fc(216)_IgG1_pI(-)_Isosteric_A_C220S/PVA_/S267K/L368D/K370S-
IgG1_PVA_/S267K/S364K/E357Q**

Chain 1 - human_IL15Ra(sushi)_(GGGGS)5-human_IL15(N4D/N65D;single-Chain
)_Fc(216)_IgG1_pI(-)_Isosteric_A_C220S/PVA_/S267K/L368D/K370S (SEQ ID NO: 851)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - Numax_IgG1_PVA_/S267K/S364K/E357Q Heavy Chain (SEQ ID NO: 852)
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK Chain 3 - Numax Light Chain (SEQ ID NO: 853)
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

Figure 15A

Human IL-15 precursor sequence

\>sp|P40933 (SEQ ID NO: 111)
MRISKPHLRSISIQCYLCLLLNSHFLTEAGIHVFILGCFSAGLPKTEANWVNVISDLKKIEDLIQSMHIDATLYT
ESDVHPSCKVTAMKCFLLELQVISLESGDASIHDTVENLIILANNSLSSNGNVTESGCKECEELEEKNIKEFLQS
FVHIVQMFINTS

Human IL-15 mature form sequence

\>sp|P40933|49-162 (SEQ ID NO: 112)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Human IL-15Rα sequence

\>sp|Q13261 (SEQ ID NO: 113)
MAPRRARGCRTLGLPALLLLLLLRPPATRGITCPPPMSVEHADIWVKSYSLYSRERYICNSGFKRKAGTSSLTEC
VLNKATNVAHWTTPSLKCIRDPALVHQRPAPPSTVTTAGVTPQPESLSPSGKEPAASSPSSNNTAATTAAIVPGS
QLMPSKSPSTGTTEISSHESSHGTPSQTTAKNWELTASASHQPPGVYPQGHSDTTVAISTSTVLLCGLSAVSLLA
CYLKSRQTPPLASVEMEAMEALPVTWGTSSRDEDLENCSHHL

Human IL-15Rα, extracellular domain

\>sp|Q13261|31-205 (SEQ ID NO: 114)
ITCPPPMSVEHADIWVKSYSLYSRERYICNSGFKRKAGTSSLTECVLNKATNVAHWTTPSLKCIRDPALVHQRPA
PPSTVTTAGVTPQPESLSPSGKEPAASSPSSNNTAATTAAIVPGSQLMPSKSPSTGTTEISSHESSHGTPSQTTA
KNWELTASASHQPPGVYPQGHSDTT

Human IL-15Rα, sushi domain

\>sp|Q13261|31-95 (SEQ ID NO: 115)
ITCPPPMSVEHADIWVKSYSLYSRERYICNSGFKRKAGTSSLTECVLNKATNVAHWTTPSLKCIR

Human IL-15Rß sequence

\>sp|P14784 (SEQ ID NO: 116)
MAAPALSWRLPLLILLLPLATSWASAAVNGTSQFTCFYNSRANISCVWSQDGALQDTSCQVHAWPDRRRWNQTCE
LLPVSQASWACNLILGAPDSQKLTTVDIVTLRVLCREGVRWRVMAIQDFKPFENLRLMAPISLQVVHVETHRCNI
SWEISQASHYFERHLEFEARTLSPGHTWEEAPLLTLKQKQEWICLETLTPDTQYEFQVRVKPLQGEFTTWSPWSQ
PLAFRTKPAALGKDTIPWLGHLLVGLSGAFGFIILVYLLINCRNTGPWLKKVLKCNTPDPSKFFSQLSSEHGGDV
QKWLSSPFPSSSFSPGGLAPEISPLEVLERDKVTQLLLQQDKVPEPASLSSNHSLTSCFTNQGYFFFHLPDALEI
EACQVYFTYDPYSEEDPDEGVAGAPTGSSPQPLQPLSGEDDAYCTFPSRDDLLLFSPSLLGGPSPPSTAPGGSGA
GEERMPPSLQERVPRDWDPQPLGPPTPGVPDLVDFQPPPELVLREAGEEVPDAGPREGVSFPWSRPPGQGEFRAL
NARLPLNTDAYLSLQELQGQDPTHLV

Human IL-15Rß, extracellular domain

\>sp|P14784|27-240 (SEQ ID NO: 117)
AVNGTSQFTCFYNSRANISCVWSQDGALQDTSCQVHAWPDRRRWNQTCELLPVSQASWACNLILGAPDSQKLTTV
DIVTLRVLCREGVRWRVMAIQDFKPFENLRLMAPISLQVVHVETHRCNISWEISQASHYFERHLEFEARTLSPGH
TWEEAPLLTLKQKQEWICLETLTPDTQYEFQVRVKPLQGEFTTWSPWSQPLAFRTKPAALGKDT

Figure 15B

Human common gamma chain sequence

>sp|P31785 (SEQ ID NO: 118)
MLKPSLPFTSLLFLQLPLLGVGLNTTILTPNGNEDTTADFFLTTMPTDSLSVSTLPLPEVQCFVFNVEYMNCTWN
SSSEPQPTNLTLHYWYKNSDNDKVQKCSHYLFSEEITSGCQLQKKEIHLYQTFVVQLQDPREPRRQATQMLKLQN
LVIPWAPENLTLHKLSESQLELNWNNRFLNHCLEHLVQYRTDWDHSWTEQSVDYRHKFSLPSVDGQKRYTFRVRS
RFNPLCGSAQHWSEWSHPIHWGSNTSKENPFLFALEAVVISVGSMGLIISLLCVYFWLERTMPRIPTLKNLEDLV
TEYHGNFSAWSGVSKGLAESLQPDYSERLCLVSEIPPKGGALGEGPGASPCNQHSPYWAPPCYTLKPET

Human common gamma chain, extracellular domain

>sp|P31785|23-262 (SEQ ID NO: 119)
LNTTILTPNGNEDTTADFFLTTMPTDSLSVSTLPLPEVQCFVFNVEYMNCTWNSSSEPQPTNLTLHYWYKNSDND
KVQKCSHYLFSEEITSGCQLQKKEIHLYQTFVVQLQDPREPRRQATQMLKLQNLVIPWAPENLTLHKLSESQLEL
NWNNRFLNHCLEHLVQYRTDWDHSWTEQSVDYRHKFSLPSVDGQKRYTFRVRSRFNPLCGSAQHWSEWSHPIHWG
SNTSKENPFLFALEA

Figure 16A-Figure 16D
Figure 16A
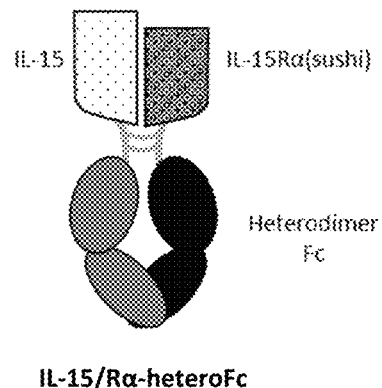
IL-15/Rα-heteroFc
Example: XENP20818
Figure 16B
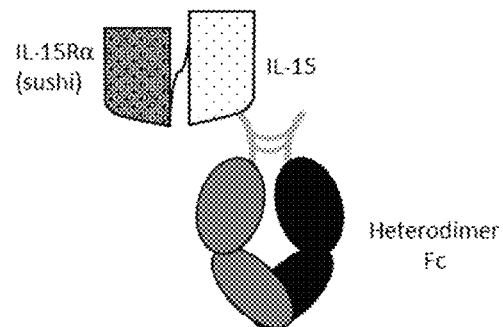
scIL-15/Rα-Fc
Example: XENP21478
Figure 16C
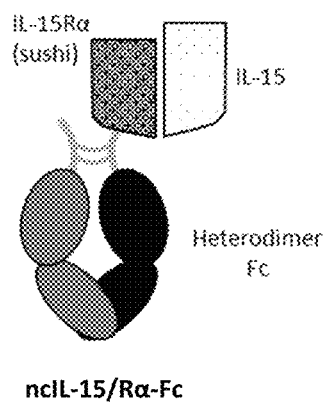
ncIL-15/Rα-Fc
Example: XENP21479
Figure 16D
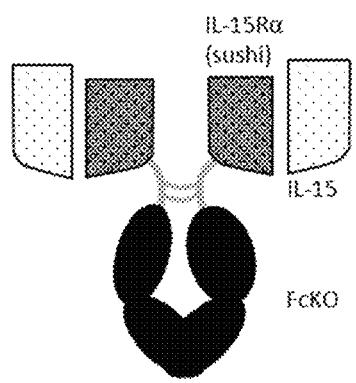
Bivalent ncIL-15/Rα-Fc
Example: XENP21978

Figure 16E-Figure 16G
Figure 16E
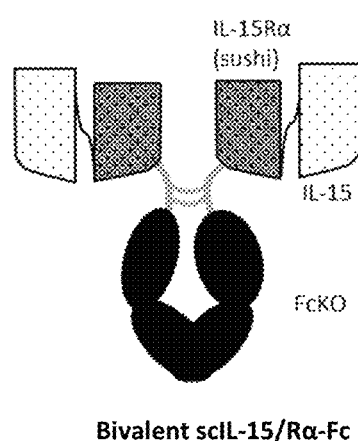
Bivalent scIL-15/Rα-Fc
Figure 16F
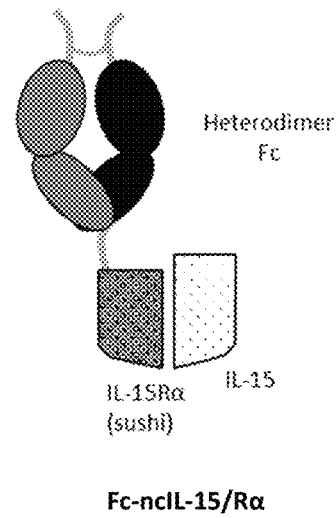
Fc-ncIL-15/Rα
Example: XENP22637
Figure 16G
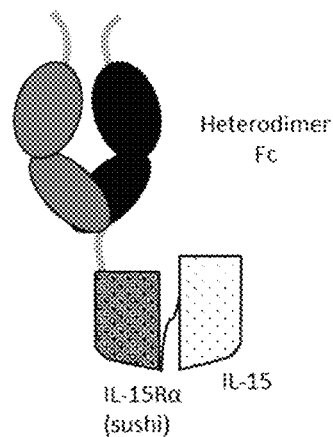
Fc-scIL-15/Rα

Figure 17

>XENP20818 – human IL15-(GGGGS)₁ x human IL15Rα(Sushi)-(GGGGS)₁ Fc heterodimer

Chain 1 - human_IL15_(GGGGS)₁_Fc(216)_IgG1_pI(-)_Isosteric_A_C220S/PVA_/S267K/L368D/K370S (SEQ ID NO: 854)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_C220S/PVA_/S267K/S364K/E357Q (SEQ ID NO: 855)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP21475 – human IL15 x human IL15Rα(Sushi) Fc heterodimer Chain 1 - human_IL15-Fc(216)_IgG1_pI(-)_Isosteric_A_C220S/PVA_/S267K/L368D/K370S (SEQ ID NO: 856)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 - human_IL15Rα(Sushi)-Fc(216)_IgG1_C220S/PVA_/S267K/S364K/E357Q (SEQ ID NO: 857)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 18

>XENP21478 – human IL15Rα(Sushi)-(GGGGS)₆-human IL15(single-chain) Fc heterodimer

Chain 1 - human_IL15Rα(sushi)_(GGGGS)₆-human_IL15-Fc(216)_IgG1_pI(-)_Isosteric_A_C220S/PVA_/S267K/L368D/K370S (SEQ ID NO: 858)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVQMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

Chain 2 - empty-Fc(216)_IgG1_C220S/PVA_/S267K/S364K/E357Q (SEQ ID NO: 136)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP21993 human_IL15Ra(sushi)_(GGGGS)5-human_IL15(single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(single-Chain)_Fc(216)_IgG1_pI(-)_Isosteric_A_C220S/PVA_/S267K/L368D/K370S scIL-15/Ra-Fc Chain (SEQ ID NO: 859)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - empty_Fc(216)_IgG1_C220S/PVA_/S267K/S364K/E357Q Chain (SEQ ID NO: 141)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP24013 human_IL15Ra(sushi)_(GGGGS)5-human_IL15(D61N;single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(D61N;single-Chain)_Fc(216)_IgG1_pI(-)_Isosteric_A_C220S/PVA_/S267K/L368D/K370S (SEQ ID NO: 860)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHNTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - empty-Fc(216)_IgG1_C220S/PVA_/S267K/S364K/E357Q (SEQ ID NO: 146)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 19A

>XENP21479 – empty-Fc-IL15(non-covalent)-human_IL15Rα(Sushi) Fc heterodimer

Chain 1 - human_IL15_no_tag (SEQ ID NO: 147)
<u>NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS</u>

Chain 2 - empty-Fc(216)_IgG1_pI(-)_Isosteric_A_C220S/PVA_/S267K/L368D/K370S (SEQ ID NO: 148)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Rα(Sushi)-Fc(216)_IgG1_C220S/PVA_/S267K/S364K/E357Q (SEQ ID NO: 861)
<u>ITCPPPMSVEHADIWVKSYSLYSRERYICNSGFKRKAGTSSLTECVLNKATNVAHWTTPSLKCIR</u>/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

**>XENP022366 – empty-Fc-IL15(non-covalent)-human_IL15Ra(sushi)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q**

Chain 1 - human_IL15_no_tag (SEQ ID NO: 152)
<u>NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS</u>

Chain 2 - empty-Fc(216)_IgG1_pI(-)_Isosteric_A_C220S/PVA_/S267K/L368D/K370S (SEQ ID NO: 153)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi)_(GGGGS)1_Fc(216)_IgG1_C220S/PVA_/S267K/S364K/E357Q (SEQ ID NO: 862)
<u>ITCPPPMSVEHADIWVKSYSLYSRERYICNSGFKRKAGTSSLTECVLNKATNVAHWTTPSLKCIR</u>/<u>GGGGS</u>/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 19B

>XENP024348_IL15(non-covalent)-human_IL15Ra(Sushi)_empty-Fc_Fc(216)_IgG1_pI(-
)_Isosteric_A_C220S/PVA_/S267K/L368D/K370S-Fc(216)_IgG1_C220S/PVA_/S267K/S364K/E357Q

Chain 1 – IL15 WT (SEQ ID NO: 157)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Chain 2 – human_IL15Ra(Sushi)_Fc(216)_IgG1_pI(-)_Isosteric_A_C220S/PVA_/S267K/L368D/K370S (SEQ ID NO: 863)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 3 – empty_Fc(216)_IgG1_C220S/PVA_/S267K/S364K/E357Q (SEQ ID NO: 161)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 20

>XENP021978 – human_IL15(non-covalent)-human_IL15Ra(Sushi)_Fc(216)_IgG1_C220S/PVA_/S267K

Chain 1 - human_IL15Ra(Sushi)-Fc(216)_IgG1_C220S/PVA_/S267K (SEQ ID NO: 864)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Chain 2 - human_IL15_no_tag (SEQ ID NO: 165)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Figure 21 human_IL15(single-chain)-human_IL15Ra(Sushi)_Fc(216)_IgG1_C220S/PVA_/S267K (SEQ ID NO: 865)

NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/ITCPPPMSVEHADIWVKSYSLYSRERYIC
NSGFKRKAGTSSLTECVLNKATNVAHWTTPSLKCIR/EPKSSDKTHTCPPCPAPPVAGPSVFLFPPKPKDTLMIS
RTPEVTCVVVDVKHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK

Figure 22

>XENP022637 – empty-Fc(216)_IgG1_pI(-)_Isosteric_A_C220S/PVA_/S267K/L368D/K370S_(GGGGS)2_IL15Ra(Sushi)_IL15(non-covalent)_IgG1_ISO(+RR)_C220S/PVA_/S267K/S364K/E357Q

Chain 1 - empty-Fc(216)_IgG1_pI(-)_Isosteric_A_C220S/PVA_/S267K/L368D/K370S_(GGGGS)2_IL15Ra(Sushi) (SEQ ID NO: 866)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIR

Chain 2 - empty-Fc(216)_IgG1_ISO(+RR)_C220S/PVA_/S267K/S364K/E357Q (SEQ ID NO: 173)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Chain 3 - human_IL15_no_tag (SEQ ID NO: 174)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

>XENP022638 - empty-Fc(216)_IgG1_pI(-)_Isosteric_A_C220S/PVA_/S267K/L368D/K370S_IgG1_ISO(+RR)_C220S/PVA_/S267K/S364K/E357Q_(GGGGS)2_IL15Rα(Sushi)_IL15(non-covalent)

Chain 1 - empty-Fc(216)_IgG1_pI(-)_Isosteric_A_C220S/PVA_/S267K/L368D/K370S (SEQ ID NO: 175)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

Chain 2 - empty-Fc(216)_IgG1_ISO(+RR)_C220S/PVA_/S267K/S364K/E357Q_(GGGGS)2_IL15Rα(Sushi) (SEQ ID NO: 867)
ERKSSDKTHTCPRCPAPPVAGPSVFLFPPKPKDTLMISRTPEVTCVVVDVKHEDPEVKFKWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVMHEALHNHYTQKSLSLSPGK/GGGGSGGGGS/ITCPPPMSVEHADIWVKSYSLYSRERY
ICNSGFKRKAGTSSLTECVLNKATNVAHWTTPSLKCIR

Chain 3 – human_IL15 (SEQ ID NO: 179)
NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

Figure 23 empty-Fc(216)_IgG1_pI(-
)_Isosteric_A_C220S/PVA_/S267K/L368D/K370S_(GGGGS)2_IL15Ra(Sushi)_IL15(single-
chain)_IgG1_ISO(+RR)_C220S/PVA_/S267K/S364K/E357Q Chain 1 - empty-Fc(216)_IgG1_pI(-
)_Isosteric_A_C220S/PVA_/S267K/L368D/K370S_(GGGGS)2_IL15Ra(Sushi)_IL15(single-chain) (SEQ ID NO: 868)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIR/GGGGS/NWVNVISDLKKIEDLIQSMHIDATLYTESDVHPSCKVTAMKCFLLELQVISLESGDASIH
DTVENLIILANNSLSSNGNVTESGCKECEELEEKNIKEFLQSFVHIVQMFINTS Chain 2 - empty-Fc(216)_IgG1_ISO(+RR)_C220S/PVA_/S267K/S364K/E357Q (8927) (SEQ ID NO: 184)
ERKSSDKTHTCPPCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 27

IL-15Rα(sushi-D96) (SEQ ID NO: 185)
ITCPPPMSVEHADIWVKSYSLYSRERYICNSGFKRKAGTSSLTECVLNKATNVAHWTTPSLKCIRD

IL-15Rα(sushi-D96/P97) (SEQ ID NO: 186)
ITCPPPMSVEHADIWVKSYSLYSRERYICNSGFKRKAGTSSLTECVLNKATNVAHWTTPSLKCIRDP

IL-15Rα(sushi-D96/P97/A98) (SEQ ID NO: 187)
ITCPPPMSVEHADIWVKSYSLYSRERYICNSGFKRKAGTSSLTECVLNKATNVAHWTTPSLKCIRDPA

Figure 28

IL-15(E87C) (SEQ ID NO: 188)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

IL-15(V49C) (SEQ ID NO: 189)
NWVNVISDLKKIEDLIQSMHIDATLYTESDVHPSCKVTAMKCFLLELQCISLESGDASIHDTVENLIILANNSLS
SNGNVTESGCKECEELEEKNIKEFLQSFVHIVQMFINTS

IL-15(L52C) (SEQ ID NO: 190)
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS

IL-15(E89C) (SEQ ID NO: 191)
NWVNVISDLKKIEDLIQSMHIDATLYTESDVHPSCKVTAMKCFLLELQVISLESGDASIHDTVENLIILANNSLS
SNGNVTESGCKECCELEEKNIKEFLQSFVHIVQMFINTS

IL-15(Q48C) (SEQ ID NO: 192)
NWVNVISDLKKIEDLIQSMHIDATLYTESDVHPSCKVTAMKCFLLELCVISLESGDASIHDTVENLIILANNSLS
SNGNVTESGCKECEELEEKNIKEFLQSFVHIVQMFINTS

IL-15(E53C) (SEQ ID NO: 193)
NWVNVISDLKKIEDLIQSMHIDATLYTESDVHPSCKVTAMKCFLLELQVISLCSGDASIHDTVENLIILANNSLS
SNGNVTESGCKECEELEEKNIKEFLQSFVHIVQMFINTS

IL-15(C42S) (SEQ ID NO: 194)
NWVNVISDLKKIEDLIQSMHIDATLYTESDVHPSCKVTAMKSFLLELQVISLESGDASIHDTVENLIILANNSLS
SNGNVTESGCKECEELEEKNIKEFLQSFVHIVQMFINTS

IL-15(L45C) (SEQ ID NO: 195)
NWVNVISDLKKIEDLIQSMHIDATLYTESDVHPSCKVTAMKCFLCELQVISLESGDASIHDTVENLIILANNSLS
SNGNVTESGCKECEELEEKNIKEFLQSFVHIVQMFINTS

Figure 29

IL-15Rα(sushi-D96/C97) (SEQ ID NO: 196)
ITCPPPMSVEHADIWVKSYSLYSRERYICNSGFKRKAGTSSLTECVLNKATNVAHWTTPSLKCIRDC

IL-15Rα(sushi-D96/P97/C98) (SEQ ID NO: 197)
ITCPPPMSVEHADIWVKSYSLYSRERYICNSGFKRKAGTSSLTECVLNKATNVAHWTTPSLKCIRDPC

IL-15Rα(sushi-D96/C97/A98) (SEQ ID NO: 198)
ITCPPPMSVEHADIWVKSYSLYSRERYICNSGFKRKAGTSSLTECVLNKATNVAHWTTPSLKCIRDCA

IL-15Rα(sushi-S40C) (SEQ ID NO: 199)
ITCPPPMSVEHADIWVKSYSLYSRERYICNSGFKRKAGTCSLTECVLNKATNVAHWTTPSLKCIR

IL-15Rα(sushi-K34C) (SEQ ID NO: 200)
ITCPPPMSVEHADIWVKSYSLYSRERYICNSGFCRKAGTSSLTECVLNKATNVAHWTTPSLKCIR

IL-15Rα(sushi-G38C) (SEQ ID NO: 201)
ITCPPPMSVEHADIWVKSYSLYSRERYICNSGFKRKACTSSLTECVLNKATNVAHWTTPSLKCIR

IL-15Rα(sushi-L42C) (SEQ ID NO: 202)
ITCPPPMSVEHADIWVKSYSLYSRERYICNSGFKRKAGTSSCTECVLNKATNVAHWTTPSLKCIR

IL-15Rα(sushi-A37C) (SEQ ID NO: 203)
ITCPPPMSVEHADIWVKSYSLYSRERYICNSGFKRKCGTSSLTECVLNKATNVAHWTTPSLKCIR Figure 30A-Figure 30D
Figure 30A
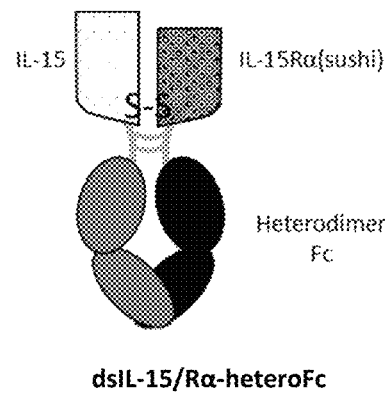
dsIL-15/Rα-heteroFc
Example: XENP22013
Figure 30B
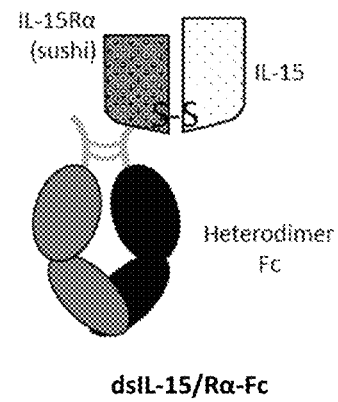
dsIL-15/Rα-Fc
Example: XENP22357
Figure 30C
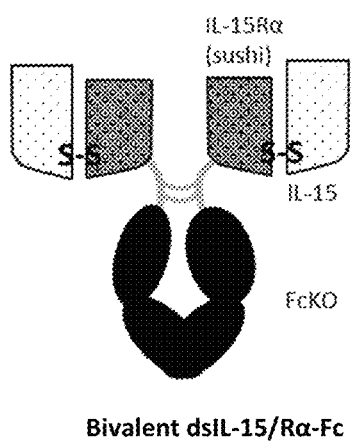
Bivalent dsIL-15/Rα-Fc
Example: XENP22634
Figure 30D
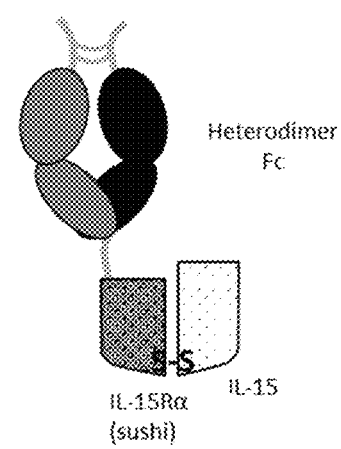
Fc-dsIL-15/Rα
Example: XENP22639

Figure 31A

>XENP022013 human_IL15_E87C_(GGGGS)1-human_IL15Ra(Sushi-D96/C97)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E87C_(GGGGS)1_Fc(216)_IgG1_pI(-)_Isosteric_A_C220S/PVA_/S267K/L368D/K370S
(SEQ ID NO: 869)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/C97)_(GGGGS)1_Fc(216)_IgG1_C220S/PVA_/S267K/S364K/E357Q (SEQ ID NO: 870)
ITCPPPMSVEHADIWVKSYSLYSRERYICNSGFKRKAGTSSLTECVLNKATNVAHWTTPSLKCIRDC/GGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLTVLHQDWLNGKEYKCK
VSNKALPAPIEKTISKAKGQPREPQVYTLPPSREQMTKNQVKLTCLVKGFYPSDIAVEWESNGQPENNYKTTPPVLDSDGSFFLYSKLTV
DKSRWQQGNVFSCSVMHEALHNHYTQKSLSLSPGK >XENP022014 human_IL15_E87C_(GGGGS)1-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E87C_(GGGGS)1_Fc(216)_IgG1_pI(-)_Isosteric_A_C220S/PVA_/S267K/L368D/K370S
(SEQ ID NO: 871)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/P97/C98)_(GGGGS)1_Fc(216)_IgG1_C220S/PVA_/S267K/S364K/E357Q
(SEQ ID NO: 872)
ITCPPPMSVEHADIWVKSYSLYSRERYICNSGFKRKAGTSSLTECVLNKATNVAHWTTPSLKCIRDPC/GGGGS/EPKSSDKTHTCPPCP
APPVAGPSVFLFPPKPKDTLMISRTPEVTCVVVDVKHEDPEVKFNWYVDGVEVHNAKTKPREEQYNSTYRVVSVLTVLHQDWLNGKEYKC
KVSNKALPAPIEKTISKAKGQPREPQVYTLPPSREQMTKNQVKLTCLVKGFYPSDIAVEWESNGQPENNYKTTPPVLDSDGSFFLYSKLT
VDKSRWQQGNVFSCSVMHEALHNHYTQKSLSLSPGK >XENP022015 human_IL15_E87C_(GGGGS)1-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_E87C_(GGGGS)1_Fc(216)_IgG1_pI(-)_Isosteric_A_C220S/PVA_/S267K/L368D/K370S
(SEQ ID NO: 873)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 - human_IL15Ra(Sushi-D96/C97/A98)_(GGGGS)1_Fc(216)_IgG1_C220S/PVA_/S267K/S364K/E357Q
(SEQ ID NO: 874)
ITCPPPMSVEHADIWVKSYSLYSRERYICNSGFKRKAGTSSLTECVLNKATNVAHWTTPSLKCIRDCA/GGGGS/EPKSSDKTHTCPPCP
APPVAGPSVFLFPPKPKDTLMISRTPEVTCVVVDVKHEDPEVKFNWYVDGVEVHNAKTKPREEQYNSTYRVVSVLTVLHQDWLNGKEYKC
KVSNKALPAPIEKTISKAKGQPREPQVYTLPPSREQMTKNQVKLTCLVKGFYPSDIAVEWESNGQPENNYKTTPPVLDSDGSFFLYSKLT
VDKSRWQQGNVFSCSVMHEALHNHYTQKSLSLSPGK

Figure 31B

>XENP022017 human_IL15_L52C_(GGGGS)1-human_IL15Ra(Sushi-S40C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 – human_IL15_L52C_(GGGGS)1-_Fc(216)_IgG1_pI(-)_Isosteric_A_C220S/PVA_/S267K/L368D/K370S
(SEQ ID NO: 875)
NWVNVISDLKKIEDLIQSMHIDATLYTESDVHPSCKVTAMKCFLLELQVISCESGDASIHDTVENLIILANNSLSSNGNVTESGCKECEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 – human_IL15Ra(Sushi-S40C)_(GGGGS)1_Fc(216)_IgG1_C220S/PVA_/S267K/S364K/E357Q (SEQ ID NO: 876)
ITCPPPMSVEHADIWVKSYSLYSRERYICNSGFKRKAGTCSLTECVLNKATNVAHWTTPSLKCIR/GGGGS/EPKSSDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Figure 32A

>XENP022358 – empty-Fc-IL15_E87C-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_no_tag (SEQ ID NO: 228)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

Chain 2 - empty-Fc(216)_IgG1_pI(-)_Isosteric_A_C220S/PVA_/S267K/L368D/K370S (SEQ ID NO: 229)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-D96/P97/C98)_(GGGGS)1_Fc(216)_IgG1_C220S/PVA_/S267K/S364K/E357Q
(SEQ ID NO: 877)
ITCPPPMSVEHADIWVKSYSLYSRERYICNSGFKRRAGTSSLTECVLNKATNVAHWTTPSLKCIRDPC/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP022359 – empty-Fc-IL15_E87C-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_no_tag (SEQ ID NO: 233)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

Chain 2 - empty-Fc(216)_IgG1_pI(-)_Isosteric_A_C220S/PVA_/S267K/L368D/K370S (SEQ ID NO: 234)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-D96/C97/A98)_(GGGGS)1_Fc(216)_IgG1_C220S/PVA_/S267K/S364K/E357Q
(SEQ ID NO: 878)
ITCPPPMSVEHADIWVKSYSLYSRERYICNSGFKRRAGTSSLTECVLNKATNVAHWTTPSLKCIRDCA/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 32B

>XENP022361 – empty-Fc-IL15_L52C-human_IL15Ra(Sushi-S40C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_L52C_no_tag (SEQ ID NO: 238)
NWVNVISDLKKIEDLIQSMHIDATLYTESDVHPSCKVTAMKCFLLELQVISCESGDASIHDTVENLIILANNSLS
SNGNVTESGCKECEEELEEKNIKEFLQSFVHIVQMFINTS

Chain 2 - empty-Fc(216)_IgG1_pI(-)_Isosteric_A_C220S/PVA_/S267K/L368D/K370S (SEQ ID NO: 239)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-S40C)_(GGGGS)1_Fc(216)_IgG1_C220S/PVA_/S267K/S364K/E357Q (SEQ ID NO: 879)
ITCPPPMSVEHADIWVKSYSLYSRERYICNSGFKRKAGTCSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022684 empty-Fc-IL15_E87C-human_IL15Ra(Sushi-D96/C97/A98)_Fc(216)_IgG1_pI(-)_Isosteric_A_C220S/PVA_/S267K/L368D/K370S-Fc(216)_IgG1_C220S/PVA_/S267K/S364K/E357Q

Chain 1 – IL15_E87C (SEQ ID NO: 243)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS

Chain 2 - IL15Ra(Sushi-D96/C97/A98)_Fc(216)_IgG1_pI(-)_Isosteric_A_C220S/PVA_/S267K/L368D/K370S
(SEQ ID NO: 880)
ITCPPPMSVEHADIWVKSYSLYSRERYICNSGFKRKAGTSSLTECVLNKATNVAHWTTPSLKCIRDCA/EPKSSDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREQMTKNQVKLTCLVKGFYPSDIAVEWESNGQPENNYKTTPPVLDSDGSFFLYSKLTVDKSRW
QQGNVFSCSVMHEALHNHYTQKSLSLSPGK

Figure 33

>XENP022634 – human_IL15(E87C)-human_IL15Ra(Sushi-D96/C97)_Fc(216)_IgG1_C220S/PVA_/S267K

Chain 1 - human_IL15Ra(Sushi-D96/C97)-Fc(216)_IgG1_C220S/PVA_/S267K (SEQ ID NO: 881)
ITCPPPMSVEHADIWVKSYSLYSRERYICNSGFKRKAGTSSLTECVLNKATNVAHWTTPSLKCIRDC/EPKSSDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK Chain 2 - human_IL15_E87C_no_tag (SEQ ID NO: 250)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

>XENP022635 – human_IL15(E87C)-human_IL15Ra(Sushi-D96/C97/A98)_Fc(216)_IgG1_C220S/PVA_/S267K

Chain 1 - human_IL15Ra(Sushi-D96/C97/A98)-Fc(216)_IgG1_C220S/PVA_/S267K (SEQ ID NO: 882)
ITCPPPMSVEHADIWVKSYSLYSRERYICNSGFKRKAGTSSLTECVLNKATNVAHWTTPSLKCIRDCA/EPKSSD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK Chain 2 - human_IL15_E87C_no_tag (SEQ ID NO: 254)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

>XENP022636 – human_IL15(L52C)-human_IL15Ra(Sushi-S40C)_Fc(216)_IgG1_C220S/PVA_/S267K

Chain 1 - human_IL15Ra(Sushi-S40C)-Fc(216)_IgG1_C220S/PVA_/S267K (SEQ ID NO: 883)
ITCPPPMSVEHADIWVKSYSLYSRERYICNSGFKRKAGTCSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK Chain 2 - human_IL15_L52C_no_tag (SEQ ID NO: 258)
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS

>XENP022687 - human_IL15_E87C-human_IL15Ra(Sushi-D96/C97/A98)_Fc(216)_IgG1_C220S/PVA_/S267K

Chain 1 – human_IL15Ra(sushi-D96/C97/A98)_Fc(216)_IgG1_C220S/PVA_/S267K (SEQ ID NO: 884)
ITCPPPMSVEHADIWVKSYSLYSRERYICNSGFKRKAGTSSLTECVLNKATNVAHWTTPSLKCIRDCA/EPKSSDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREEMTKNQVSLTCLVKGFYPSDIAVEWESNGQPENNYKTTPPVLDSDGSFFLYSKLTVDKSRW
QQGNVFSCSVMHEALHNHYTQKSLSLSPGK Chain 2 – human_IL15_E87C (SEQ ID NO: 262)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS

Figure 34

>XENP022639 – empty-Fc(216)_IgG1_pI(-
)_Isosteric_A_C220S/PVA_/S267K/L368D/K370S_(GGGGS)2_IL15Ra(Sushi-
D96/C97)_IL15(E87C)_IgG1_ISO(+RR)_C220S/PVA_/S267K/S364K/E357Q Chain 1 - empty-Fc(216)_IgG1_pI(-)_Isosteric_A_C220S/PVA_/S267K/L368D/K370S_(GGGGS)2_IL15Ra(Sushi-
D96/C97) (17605) (SEQ ID NO: 885)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIRDC Chain 2 - empty-Fc(216)_IgG1_ISO(+RR)_C220S/PVA_/S267K/S364K/E357Q (8927) (SEQ ID NO: 266)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK Chain 3 - human_IL15_E87C_no_tag (17074) (SEQ ID NO: 267)
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS >XENP022640 empty-Fc(216)_IgG1_pI(-
)_Isosteric_A_C220S/PVA_/S267K/L368D/K370S_IgG1_ISO(+RR)_C220S/PVA_/S267K/S364K/E357Q_(GGGGS
)2_IL15Ra(Sushi-D96/C97)_IL15(E87C)

Chain 1 – IL15 (SEQ ID NO: 268)
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS Chain 2 – empty_Fc(216)_IgG1_pI(-)_Isosteric_A_C220S/PVA_/S267K/L368D/K370S (SEQ ID NO: 269)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

Figure 38A

N1D (SEQ ID NO: 270)
DWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

N4D (SEQ ID NO: 271)
NWVDVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D8N (SEQ ID NO: 272)
NWVNVISNLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D30N (SEQ ID NO: 273)
NWVNVISDLKKIEDLIQSMHIDATLYTESNVHPSCKVTAMKCFLLELQVISLESGDASIHDTVENLIILANNSLSSNGNVTESGCKECEE
LEEKNIKEFLQSFVHIVQMFINTS

D61N (SEQ ID NO: 274)
NWVNVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

E64Q (SEQ ID NO: 275)
NWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

N65D (SEQ ID NO: 276)
NWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

Q108E (SEQ ID NO: 277)
NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVEMFINTS

N1D/D61N (SEQ ID NO: 278)
DWVNVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

N1D/E64Q (SEQ ID NO: 279)
DWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

N4D/D61N (SEQ ID NO: 280)
NWVDVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

N4D/E64Q (SEQ ID NO: 281)
NWVDVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

D8N/D61N (SEQ ID NO: 282)
NWVNVISNLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

Figure 38B

D8N/E64Q (SEQ ID NO: 283)
NWVNVISNLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

D61N/E64Q (SEQ ID NO: 284)
NWVNVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVQMFINTS

E64Q/Q108E (SEQ ID NO: 285)
NWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVEMFINTS

N1D/N4D/D8N (SEQ ID NO: 286)
DWVDVISNLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D61N/E64Q/N65D (SEQ ID NO: 287)
NWVNVISDLKKIEDLIQSMHIDATLYTESDVHPSCKVTAMKCFLLELQVISLESGDASIHNTVQDLIILANNSLSSNGNVTESGCKECEE
LEEKNIKEFLQSFVHIVQMFINTS

N1D/D61N/E64Q/Q108E (SEQ ID NO: 288)
DWVNVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVEMFINTS

N4D/D61N/E64Q/Q108E (SEQ ID NO: 289)
NWVDVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVEMFINTS

N1D/N65D (SEQ ID NO: 290)
DWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

N1D/Q108E (SEQ ID NO: 291)
DWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVEMFINTS

N4D/N65D (SEQ ID NO: 292)
NWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

D30N/N65D (SEQ ID NO: 293)
NWVNVISDLKKIEDLIQSMHIDATLYTESNVHPSCKVTAMKCFLLELQVISLESGDASIHDTVEDLIILANNSLSSNGNVTESGCKECEE
LEEKNIKEFLQSFVHIVQMFINTS

D30N/Q108E (SEQ ID NO: 294)
NWVNVISDLKKIEDLIQSMHIDATLYTESNVHPSCKVTAMKCFLLELQVISLESGDASIHDTVENLIILANNSLSSNGNVTESGCKECEE
LEEKNIKEFLQSFVHIVEMFINTS

N65D/Q108E (SEQ ID NO: 295)
NWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVEMFINTS

Figure 38C

<u>E64Q/N65D (SEQ ID NO: 296)</u>
NWVNVISDLKKIEDLIQSMHIDATLYTESDVHPSCKVTAMKCFLLELQVISLESGDASIHDTVQDLIILANNSLSSNGNVTESGCKECEE
LEEKNIKEFLQSFVHIVQMFINTS

<u>N1D/N4D/N65D (SEQ ID NO: 297)</u>
DWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

<u>D30N/E64Q/N65D (SEQ ID NO: 298)</u>
NWVNVISDLKKIEDLIQSMHIDATLYTESNVHPSCKVTAMKCFLLELQVISLESGDASIHDTVQDLIILANNSLSSNGNVTESGCKECEE
LEEKNIKEFLQSFVHIVQMFINTS

<u>N4D/D61N/N65D (SEQ ID NO: 299)</u>
NWVDVISDLKKIEDLIQSMHIDATLYTESDVHPSCKVTAMKCFLLELQVISLESGDASIHNTVEDLIILANNSLSSNGNVTESGCKECEE
LEEKNIKEFLQSFVHIVQMFINTS

Figure 39A

>XENP022821 - human_IL15_N65D_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_N65D_(GGGGS)₁ (17692) (SEQ ID NO: 886)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NO: 887)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022822 - human_IL15_Q108E_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_Q108E_(GGGGS)₁ (17693) (SEQ ID NO: 888)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
(SEQ ID NO: 889)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 39B

>XENP23343 human_IL15_N65D_(GGGGS)1-human_IL15Ra(Sushi)_(GGGGS)1_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S Chain 1 - human_IL15_N65D_(GGGGS)1_Fc(216)_IgG1_pI(-)_Isosteric_A_C220S/PVA_/S267K/L368D/K370S/M428L/N434S (SEQ ID NO: 890)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 - human_IL15Ra(Sushi)_(GGGGS)1_Fc(216)_IgG1_C220S/PVA_/S267K/S364K/E357Q/M428L/N434S
(SEQ ID NO: 891)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK >XENP023554 - human_IL15_N1D/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N1D/N65D_(GGGGS)1_Fc(216)_IgG1_pI(-)_Isosteric_A_C220S/PVA_/S267K/L368D/K370S (18783) (SEQ ID NO: 892)
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) (SEQ ID NO: 893)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 39C

>XENP023557 - human_IL15_N4D/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N4D/N65D_(GGGGS)1_Fc(216)_IgG1_pI(-)_Isosteric_A_C220S/PVA_/S267K/L368D/K370S (18786) (SEQ ID NO: 894)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) (SEQ ID NO: 895)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP023561 human_IL15_N65D/Q108E_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N65D/Q108E_(GGGGS)1_Fc(216)_IgG1_pI(-)_Isosteric_A_C220S/PVA_/S267K/L368D/K370S (SEQ ID NO: 896)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (SEQ ID NO: 897)
ITCPPPMSVEHADIWVKSYSLYSRERYICNSGFKRKAGTSSLTECVLNKATNVAHWTTPSLKCIR/GGGGS/EPKSSDKTHTCP
PCPAPPVAGPSVFLFPPKPKDTLMISRTPEVTCVVVDVKHEDPEVKFNWYVDGVEVHNAKTKPREEQYNSTYRVV
SVLTVLHQDWLNGKEYKCKVSNKALPAPIEKTISKAKGQPREPQVYTLPPSREMTKNQVKLTCLVKGFYPSDIA
VEWESNGQPENNYKTTPPVLDSDGSFFLYSKLTVDKSRWQQGNVFSCSVMHEALHNHYTQKSLSLSPGK >XENP024018 human_IL15(N65D)-human_IL15Ra(Sushi)_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15(N65D)_Fc(216)_IgG1_pI(-)_Isosteric_A_C220S/PVA_/S267K/L368D/K370S (SEQ ID NO: 898)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 - human_IL15Ra(Sushi)_Fc(216)_IgG1_C220S/PVA_/S267K/S364K/E357Q (SEQ ID NO: 899)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 39D

>XENP024019 - human_IL15(Q108E)-human_IL15Ra(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15(Q108E)-human_IL15Ra(Sushi)_Fc(216)_IgG1_pI(-
)_Isosteric_A_C220S/PVA_/S267K/L368D/K370S (19242) (SEQ ID NO: 900)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 - human_IL15Ra(Sushi)_Fc(216)_IgG1_C220S/PVA_/S267K/S364K/E357Q (16481) (SEQ ID NO: 901)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP024045 human_IL15_D30N/E64Q/N65D_(GGGGS)1-
human_IL15Rα(Sushi)_(GGGGS)1_Fc(216)_IgG1_pI(-)_Isosteric_A_C220S/PVA_/S267K/L368D/K370S-
Fc(216)_IgG1_C220S/PVA_/S267K/S364K/E357Q Chain 1 – human_IL15_D30N/E64Q/N65D_(GGGGS)1_Fc(216)_IgG1_pI(-
)_Isosteric_A_C220S/PVA_/S267K/L368D/K370S (SEQ ID NO: 902)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 – human_IL15Rα(Sushi)_(GGGGS)1_Fc(216)_IgG1_C220S/PVA_/S267K/S364K/E357Q (SEQ ID NO: 903)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP024051 human_IL15_N1D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N1D/N65D-human_Fc(216)_IgG1_pI(-
)_Isosteric_A_C220S/PVA_/S267K/L368D/K370S (SEQ ID NO: 904)
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 – human_IL15Rα(Sushi)_Fc(216)_IgG1_C220S/PVA_/S267K/S364K/E357Q (SEQ ID NO: 905)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 39E

>XENP024052 human_IL15_N4D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N4D/N65D-human_ Fc(216)_IgG1_pI(-
)_Isosteric_A_C220S/PVA_/S267K/L368D/K370S (SEQ ID NO: 906)
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 – human_IL15Rα(Sushi)_Fc(216)_IgG1_C220S/PVA_/S267K/S364K/E357Q (SEQ ID NO: 907)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP24306 human_IL15_D30N/E64Q/N65D_(GGGGS)1-
human_IL15Ra(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S Chain 1 - human_IL15_D30N/E64Q/N65D_(GGGGS)1_Fc(216)_IgG1_pI(-
)_Isosteric_A_C220S/PVA_/S267K/L368D/K370S/M428L/N434S (SEQ ID NO: 908)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK Chain 2 - human_IL15Ra(Sushi)_(GGGGS)1_Fc(216)_IgG1_C220S/PVA_/S267K/S364K/E357Q/M428L/N434S
(SEQ ID NO: 909)
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK

Figure 40A

>XENP24013 human_IL15Ra(sushi)_(GGGGS)5-human_IL15(D61N;single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(D61N;single-Chain)_Fc(216)_IgG1_pI(-)_Isosteric_A_C220S/PVA_/S267K/L368D/K370S (SEQ ID NO: 910)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHNTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - empty-Fc(216)_IgG1_C220S/PVA_/S267K/S364K/E357Q (SEQ ID NO: 376)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP24014 human_IL15Ra(sushi)_(GGGGS)5-human_IL15(N65D;single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(N65D;single-Chain)_Fc(216)_IgG1_pI(-)_Isosteric_A_C220S/PVA_/S267K/L368D/K370S (SEQ ID NO: 911)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - empty_Fc(216)_IgG1_C220S/PVA_/S267K/S364K/E357Q (SEQ ID NO: 381)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024015 human_IL15Ra(sushi)_(GGGGS)5-human_IL15(Q108E;single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(Q108E;single-chain)_Fc(216)_IgG1_pI(-)_Isosteric_A_C220S/PVA_/S267K/L368D/K370S (SEQ ID NO: 912)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVEMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q (SEQ ID NO: 386)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 40B

>XENP024050 human_IL15Ra(sushi)_(GGGGS)5-human_IL15_N4D/N65D_(single-chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)5-human_IL15_N4D/N65D_(single-chain)_Fc(216)_IgG1_pI(-
)_Isosteric_A_C220S/PVA_/S267K/L368D/K370S (SEQ ID NO: 913)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 – empty_Fc(216)_IgG1_C220S/PVA_/S267K/S364K/E357Q (SEQ ID NO: 391)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP24294 human_IL15Ra(sushi)_(GGGGS)5-human_IL15_N4D/N65D_(single-Chain
)-empty-Fc_Fc(216)_IgG1_pI(-)_Isosteric_A_C220S/PVA_/S267K/L368D/K370S/M428L/N434S-
Fc(216)_IgG1_C220S/PVA_/S267K/S364K/E357Q/M428L/N434S Chain 1 - human_IL15Ra(sushi)_(GGGGS)5-human_IL15_N4D/N65D_(single-Chain
)_Fc(216)_IgG1_pI(-)_Isosteric_A_C220S/PVA_/S267K/L368D/K370S/M428L/N434S (SEQ ID NO: 914)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK Chain 2 - empty_Fc(216)_IgG1_C220S/PVA_/S267K/S364K/E357Q/M428L/N434S (SEQ ID NO: 396)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVLHEALHSHYTQKSL
SLSPGK

Figure 40C

>XENP024475 human_IL15Ra(sushi)_(GGGGS)6-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)6-human_IL15(single-chain;Q108E)_Fc(216)_IgG1_pI(-)_Isosteric_A_C220S/PVA_/S267K/L368D/K370S (SEQ ID NO: 915)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGSGGGGS</u>/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVEMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q (SEQ ID NO: 401)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024476 human_IL15Ra(sushi)_(GGGGS)6-human_IL15(single-chain;N4D/N65D)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)6-human_IL15(single-chain;N4D/N65D)_Fc(216)_IgG1_pI(-)_Isosteric_A_C220S/PVA_/S267K/L368D/K370S (SEQ ID NO: 916)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGSGGGGS</u>/NWVDVISDLKKIEDLIQSMHIDATLYTESDVHPSCKVTAMKCFLLELQVISLE
SGDASIHDTVEDLIILANNSLSSNGNVTESGCKECEELEEKNIKEFLQSFVHIVQMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q (SEQ ID NO: 406)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024478 human_IL15Ra(sushi)_(GGGGS)7-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)7-human_IL15(single-chain;Q108E)_Fc(216)_IgG1_pI(-)_Isosteric_A_C220S/PVA_/S267K/L368D/K370S (SEQ ID NO: 917)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGSGGGGSGGGGS</u>/NWVNVISDLKKIEDLIQSMHIDATLYTESDVHPSCKVTAMKCFLLELQ
VISLESGDASIHDTVENLIILANNSLSSNGNVTESGCKECEELEEKNIKEFLQSFVHIVEMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q (SEQ ID NO: 411)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 40D

>XENP024479 human_IL15Ra(sushi)_(GGGGS)7-human_IL15(single-chain;N4D/N65D)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q

**Chain 1 - human_IL15Ra(sushi)_(GGGGS)7-human_IL15(single-chain;N4D/N65D)_Fc(216)_IgG1_pI(-
)_Isosteric_A_C220S/PVA_/S267K/L368D/K370S** (SEQ ID NO: 918)
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGSGGGGS/NWVDVISDLKKIEDLIQSMHIDATLYTESDVHPSCKVTAMKCFLLELQ
VISLESGDASIHDTVEDLIILANNSLSSNGNVTESGCKECEELEEKNIKEFLQSFVHIVQMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK

Chain 2 - empty-Fc_Fc(216)_IgG1_C220S/PVA_/S267K/S364K/E357Q (SEQ ID NO: 416)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP024481 human_IL15Ra(sushi)_(30AA_linker_variant)-human_IL15(single-chain;Q108E)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q

**Chain 1 - human_IL15Ra(sushi)_(30AA_linker_variant)-human_IL15(single-chain;Q108E)_Fc(216)_IgG1_pI(-
)_Isosteric_A_C220S/PVA_/S267K/L368D/K370S** (SEQ ID NO: 919)
ITCPPPMSVEHADIWVKSYSLYSRERYICNSGFKRKAGTSSLTECVLNKATNVAHWTTPSLKCIR/DPALVHQRP
APPGGGGSGGGGSGGGGSGGG/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVEMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q (SEQ ID NO: 421)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 41A

>XENP024349 IL15_Q108E_(non-covalent)-human_IL15Rα(Sushi)_empty-Fc_Fc(216)_IgG1_pI(-
)_Isosteric_A_C220S/PVA_/S267K/L368D/K370S-Fc(216)_IgG1_C220S/PVA_/S267K/S364K/E357Q

Chain 1 – human_IL15Rα(Sushi)_ Isosteric_A_C220S/PVA_/S267K/L368D/K370S (SEQ ID NO: 920)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 – empty- Fc(216)_IgG1_C220S/PVA_/S267K/S364K/E357Q (SEQ ID NO: 425)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Chain 3 – IL15_Q108E_(non-covalent) (SEQ ID NO: 426)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS >XENP024890 IL15_N4D/N65D_(non-covalent)-human_IL15Ra(Sushi)-empty-Fc_IgG1_Fc(216)_IgG1_pI(-
)_Isosteric_A_C220S/PVA_/S267K/L368D/K370S-IgG1_PVA_/S267K/S364K/E357Q

Chain 1 – IL-15_N4D/N65D (SEQ ID NO: 921)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 - human_IL15Ra(Sushi)_Fc(216)_IgG1_pI(-)_Isosteric_A_C220S/PVA_/S267K/L368D/K370S (SEQ ID NO: 922)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 3 – empty_Fc(216)_ IgG1_PVA_/S267K/S364K/E357Q (SEQ ID NO: 433)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 41B

>XENP25138 IL15_D30N/E64Q/N65D_(non-covalent)-empty-Fc_Fc(216)_IgG1_pI(-
)_Isosteric_A_C220S/PVA_/S267K/L368D/K370S-IgG1_PVA_/S267K/S364K/E357Q

Chain 1 - IL15_D30N/E64Q/N65D (SEQ ID NO: 434)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS

Chain 2 - human_IL15Ra(Sushi)_Fc(216)_IgG1_pI(-)_Isosteric_A_C220S/PVA_/S267K/L368D/K370S (SEQ ID NO: 923)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 3 - empty_Fc(216)_IgG1_PVA_/S267K/S364K/E357Q (SEQ ID NO: 438)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 42

>XENP022801 - human_IL15_N65D(non-covalent)-human_IL15Rα(Sushi)

Chain 1 - human_IL15_N65D(non-covalent) (17672) (SEQ ID NO: 439)
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS

Chain 2 - human_IL15Rα(Sushi) (17033) (SEQ ID NO: 440)
ITCPPPMSVEHADIWVKSYSLYSRERYICNSGFKRKAGTSSLTECVLNKATNVAHWTTPSLKCIR

>XENP022802 - human_IL15_Q108E(non-covalent)-human_IL15Rα(Sushi)

Chain 1 - human_IL15_Q108E(non-covalent) (17673) (SEQ ID NO: 441)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS

Chain 2 - human_IL15Rα(Sushi) (17033) (SEQ ID NO: 442)
ITCPPPMSVEHADIWVKSYSLYSRERYICNSGFKRKAGTSSLTECVLNKATNVAHWTTPSLKCIR

Figure 43

>XENP024342 human_IL15(non-covalent; Q108E)-human_IL15Rα(Sushi)_Fc(216)_IgG1_C220S/PVA_/S267K

Chain 1 – human_IL15Rα(Sushi)_Fc(216)_IgG1_C220S/PVA_/S267K (SEQ ID NO: 924)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Chain 2 –human_IL15(non-covalent; Q108E) (SEQ ID NO: 446)
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS

Figure 44

>XENP023472 empty-Fc-IL15_N65D/E87C-human_IL15Ra(Sushi-D96/C97)_Fc(216)_IgG1_pI(-)_Isosteric_A_C220S/PVA_/S267K/L368D/K370S-Fc(216)_IgG1_C220S/PVA_/S267K/S364K/E357Q

Chain 1 – empty_ Fc(216)_IgG1_pI(-)_Isosteric_A_C220S/PVA_/S267K/L368D/K370S (SEQ ID NO: 447)
EPKSSDKTHTCPPCPAPPVAGPSVFLFPPKPKDTLMISRTPEVTCVVVDKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 2 - IL15_N65D/E87C (SEQ ID NO: 448)
NWVNVISDLKKIEDLIQSMHIDATLYTESDVHPSCKVTAMKCFLLELQVISLESGDASIHDTVEDLIILANNSLS
SNGNVTESGCKCCEELEEKNIKEFLQSFVHIVQMFINTS

Chain 3 - IL15Ra(Sushi-D96/C97)_Fc(216)_IgG1_C220S/PVA_/S267K/S364K/E357Q (SEQ ID NO: 925)
ITCPPPMSVEHADIWVKSYSLYSRERYICNSGFKRKAGTSSLTECVLNKATNVAHWTTPSLKCIRDC/EPKSSDK
THTCPPCPAPPVAGPSVFLFPPKPKDTLMISRTPEVTCVVVDKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK

>XENP023473 empty-Fc-IL15_N65D/L52C-human_IL15Ra(Sushi-S40C)_Fc(216)_IgG1_pI(-)_Isosteric_A_C220S/PVA_/S267K/L368D/K370S-Fc(216)_IgG1_C220S/PVA_/S267K/S364K/E357Q

Chain 1 – empty_ Fc(216)_IgG1_pI(-)_Isosteric_A_C220S/PVA_/S267K/L368D/K370S (SEQ ID NO: 452)
EPKSSDKTHTCPPCPAPPVAGPSVFLFPPKPKDTLMISRTPEVTCVVVDKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 2 - IL15_N65D/L52C (SEQ ID NO: 453)
NWVNVISDLKKIEDLIQSMHIDATLYTESDVHPSCKVTAMKCFLLELQVISCESGDASIHDTVEDLIILANNSLS
SNGNVTESGCKECEELEEKNIKEFLQSFVHIVQMFINTS

Chain 3 - IL15Ra(Sushi-S40C)_Fc(216)_IgG1_C220S/PVA_/S267K/S364K/E357Q (SEQ ID NO: 926)
ITCPPPMSVEHADIWVKSYSLYSRERYICNSGFKRKAGTCSLTECVLNKATNVAHWTTPSLKCIR/EPKSSDKTH
TCPPCPAPPVAGPSVFLFPPKPKDTLMISRTPEVTCVVVDKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 46

| XENP | Variant | EC50 pM (NK cells) | Fold reduced (NK cells) | EC50 pM (CD8 T cells) | Fold reduced (CD8 T cells) |
|---|---|---|---|---|---|
| 20818 | WT | 200.6 | | 637.1 | |
| 21478 | single-chain | 848.5 | 4.2 | 4982.0 | 7.8 |
| 22815 | N1D | 281.3 | 1.4 | 1051.0 | 1.6 |
| 22816 | N4D | 321.9 | 1.6 | 1190.0 | 1.9 |
| 22817 | D8N | very weak | very weak | very weak | very weak |
| 22818 | D30N | 376.3 | 1.9 | 1366.0 | 2.1 |
| 22819 | D61N | 5934.0 | 29.6 | 161937.0 | >100 |
| 22820 | E64Q | 877.0 | 4.4 | 2858.0 | 4.5 |
| 22821 | N65D | 2883.0 | 14.4 | 6928.0 | 10.9 |
| 22822 | Q108E | 9777.0 | 48.7 | very weak | >100 |
| 22823 | N1D/D61N | 918.0 | 4.6 | 4225.0 | 6.6 |
| 22824 | N1D/E64Q | 1091.0 | 5.4 | 4228.0 | 6.6 |
| 22825 | N4D/D61N | 309.0 | 1.5 | 1070.0 | 1.7 |
| 22826 | N4D/E64Q | very weak | very weak | very weak | very weak |
| 22827 | D8N/D61N | ND | ND | ND | ND |
| 22828 | D8N/E64Q | 597.7 | 3.0 | 1658.0 | 2.6 |
| 22829 | D61N/E64Q | 458.2 | 2.3 | 2115.0 | 3.3 |
| 22830 | E64Q/Q108E | 436.6 | 2.2 | 1815.0 | 2.8 |
| 22831 | N1D/N4D/D8N | very weak | very weak | very weak | very weak |
| 22832 | D61N/E64Q/N65D | ND | ND | ND | ND |
| 22833 | N1D/D61N/E64Q/Q108E | ND | ND | ND | ND |
| 22834 | N4D/D61N/E64Q/Q108E | very weak | very weak | very weak | very weak |

| XENP | EC50 nM (NK cells) | Fold reduced (NK cells) | EC50 nM (CD8 T cells) | Fold reduced (CD8 T cells) | EC50 nM (CD4 T cells) | Fold reduced (CD4 T cells) |
|---|---|---|---|---|---|---|
| 20818 | 0.3223 | 1.0 | 2.701 | 1.0 | 16.467 | 1.0 |
| 21478 | 1.116 | 3.5 | 11.728 | 4.3 | 28.349 | 1.7 |
| 22818 | 0.4205 | 1.3 | 2.829 | 1.0 | 40.676 | 2.5 |
| 22819 | 1.016 | 3.2 | 8.254 | 3.1 | 18.101 | 1.1 |
| 22820 | 0.562 | 1.7 | 3.918 | 1.5 | 10.362 | 0.6 |
| 22821 | 3.14 | 9.7 | 18.706 | 6.9 | 112.823 | 6.9 |
| 22822 | 68.866 | 213.7 | 6439.69 | 2384.2 | 48.738 | 3.0 |
| 22825 | 1.769 | 5.5 | 12.09 | 4.5 | 60.081 | 3.6 |
| 22826 | 1.448 | 4.5 | 9.678 | 3.6 | 22.41 | 1.4 |
| 22829 | 4.839 | 15.0 | 29.638 | 11.0 | 337.571 | 20.5 |
| 22834 | 331.293 | 1027.9 | 4107.897 | 1520.9 | ND | ND |
| IL-15 | 0.05322 | 0.2 | 0.3452 | 0.1 | ND | ND |

Figures 48A-Figure 48B
Figure 48A
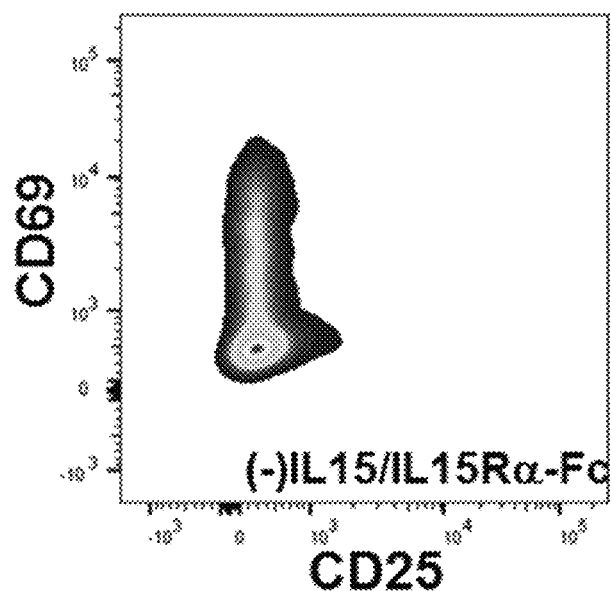
Figure 48B
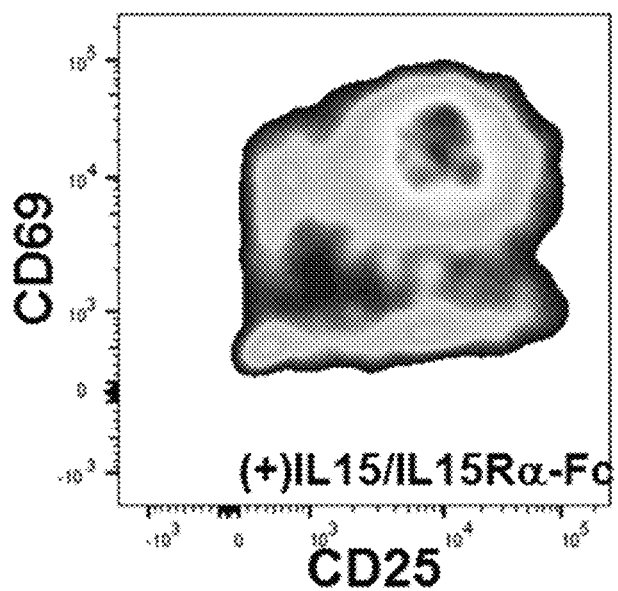

Figures 57A- Figure 57D
Figure 57A
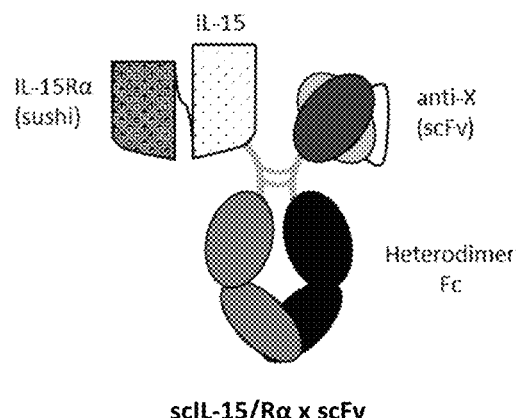
scIL-15/Rα x scFv
Figure 57B
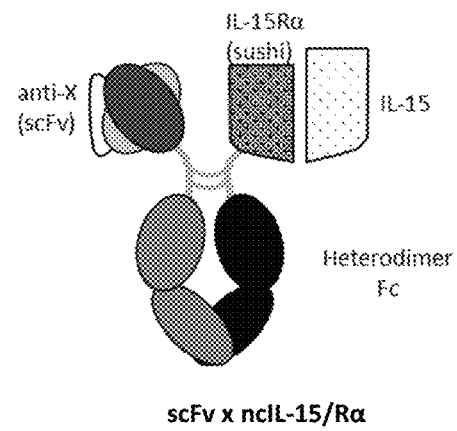
scFv x ncIL-15/Rα
Figure 57C
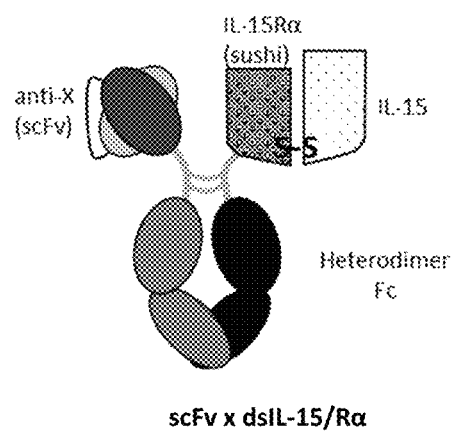
scFv x dsIL-15/Rα
Figure 57D
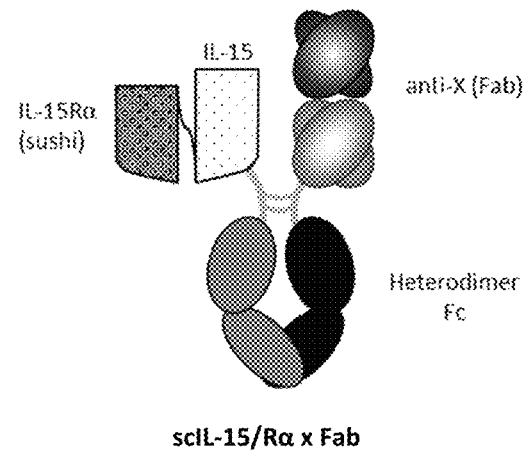
scIL-15/Rα x Fab
Example: XENP24114

Figures 57E- Figure 57H
Figure 57E
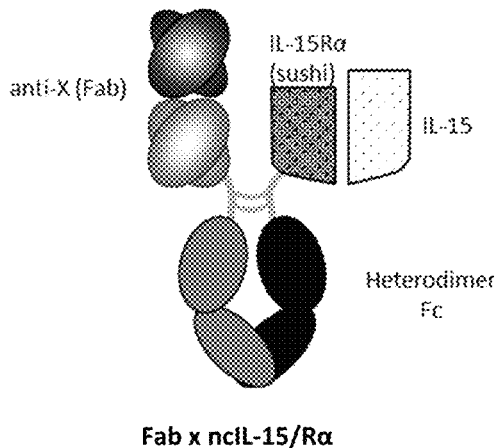
Fab x ncIL-15/Rα
Example: XENP25137
Figure 57F
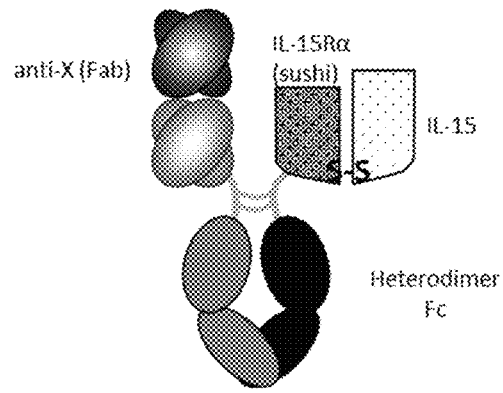
Fab x dsIL-15/Rα
Figure 57G
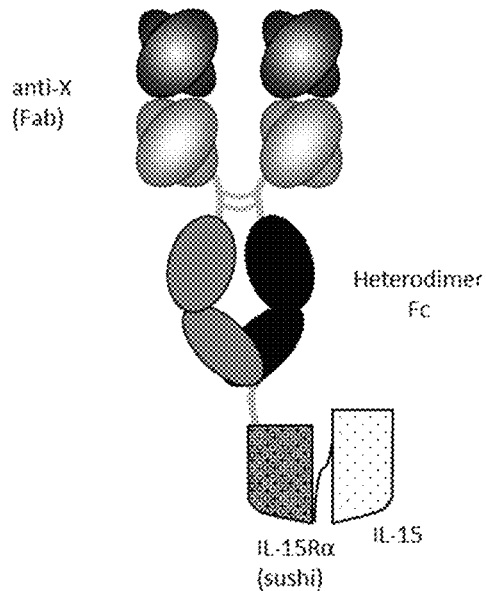
mAb-scIL-15/Rα
Example: XENP24546
Figure 57H
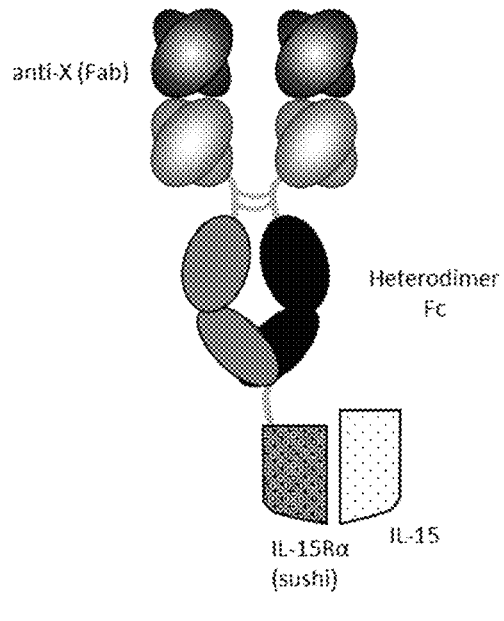
mAb-ncIL-15/Rα
Example: XENP24543

Figures 57I- Figure 57K
Figure 57I
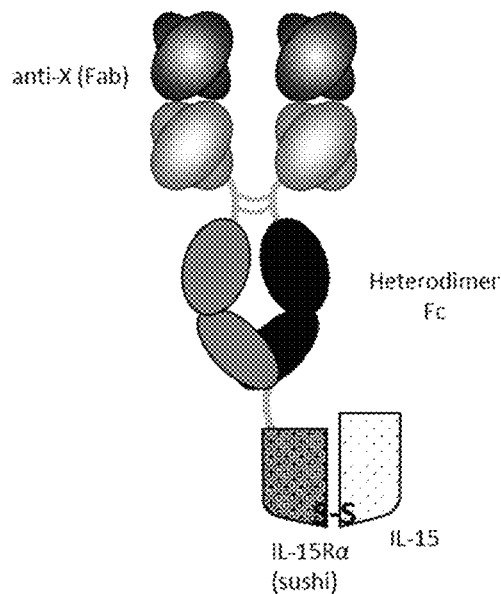
mAb-dsIL-15/Rα
Figure 57J
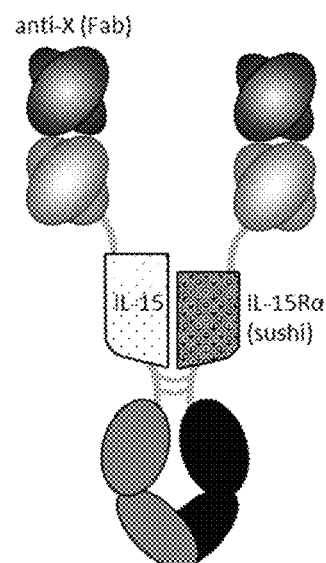
central-IL-15/Rα
Example: XENP24547
Figure 57K
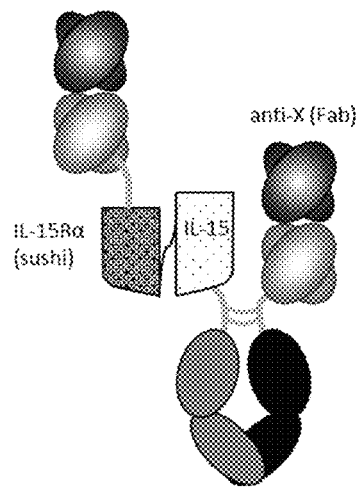
central-scIL-15/Rα
Example: XENP24548

Figure 58

>XENP024541 monalizumab[NKG2A] H1L1

Chain 1 - monalizumab[NKG2A]_H1L1 Heavy Chain (SEQ ID NO: 927)
QVQLVQSGAEVKKPGASVKVSCKASGYTFTSYWMNWVRQAPGQGLEWMGRIDPYDSETHYAQKLQGRVTMTTDTS
TSTAYMELRSLRSDDTAVYYCARGGYDFDVGTLYWFFDVWGQGTTVTVSS/ASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDKKVE
PKSCDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREEMTKNQVSLTC
LVKGFYPSDIAVEWESNGQPENNYKTTPPVLDSDGSFFLYSKLTVDKSRWQQGNVFSCSVMHEALHNHYTQKSLS
LSPGK Chain 2 - monalizumab[NKG2A]_H1L1 Light Chain (SEQ ID NO: 928)
DIQMTQSPSSLSASVGDRVTITCRASENIYSYLAWYQQKPGKAPKLLIYNAKTLAEGVPSRFSGSGSGTDFTLTI
SSLQPEDFATYYCQHHYGTPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP024542 monalizumab[NKG2A] H0L0
Chain 1 - monalizumab[NKG2A]_H0L0 Heavy Chain (SEQ ID NO: 929)
QVQLQQPGAELVRPGASVKLSCKASGYTFTSYWMNWVKQRPEQGLQWIGRIDPYDSETHYSQKFKDKAILTVDKS
SSTAYMRLSSLTSEDSAVYYCARGGYDFDVGTLYWFFDVWGAGTTVTVSS/ASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDKKVE
PKSCDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREEMTKNQVSLTC
LVKGFYPSDIAVEWESNGQPENNYKTTPPVLDSDGSFFLYSKLTVDKSRWQQGNVFSCSVMHEALHNHYTQKSLS
LSPGK Chain 2 - monalizumab[NKG2A]_H0L0 Light Chain (SEQ ID NO: 930)
DIQMTQSPASLSASVGETVTITCRASENIYSYLAWYQQKQGKSPQFLVYNAKTLAEGVPSRFSGSGSGTQFSLKI
NSLQPEDFGSYYCQHHYGTPRTFGGGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 59

>XENP024365 MS[NKG2D] H0L0
Chain 1 - MS[NKG2D]_H0L0 Heavy Chain (SEQ ID NO: 931)
QVHLQESGPGLVKPSETLSLTCTVSDDSISSYYWSWIRQPPGKGLEWIGHISYSGSANYNPSLKSRVTISVDTSK
NQFSLKLSSVTAADTAVYYCANWDDAFNIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTC
PPCPAPPVAGPSVFLFPPKPKDTLMISRTPEVTCVVVDVKHEDPEVKFNWYVDGVEVHNAKTKPREEEYNSTYRV
VSVLTVLHQDWLNGKEYKCKVSNKALPAPIEKTISKAKGQPREPQVYTLPPSREEMTKNQVSLTCDVSGFYPSDI
AVEWESDGQPENNYKTTPPVLDSDGSFFLYSKLTVDKSRWEQGDVFSCSVMHEALHNHYTQKSLSLSPGK Chain 2 - MS[NKG2D]_H0L0 Light Chain (SEQ ID NO: 932)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPWTFGQGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 60A

>XENP024531 human IL15Rα(sushi)-human IL15(N65D;single-Chain) x
monalizumab[NKG2A] H1L1 IgG1

Chain 1 - human_IL15Rα(sushi)_(GGGGS)5-human_IL15(N65D; single-chain)-Fc
(SEQ ID NO: 933)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - monalizumab[NKG2A]_H1L1 Fab-Fc Heavy Chain (SEQ ID NO: 934)
QVQLVQSGAEVKKPGASVKVSCKASGYTFTSYWMNWVRQAPGQGLEWMGRIDPYDSETHYAQKLQGRVTMTTDTS
TSTAYMELRSLRSDDTAVYYCARGGYDFDVGTLYWFFDVWGQGTTVTSS/ASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDKKVE
PKSCDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLS
LSPGK Chain 3 - monalizumab[NKG2A]_H1L1 Light Chain(SEQ ID NO: 935)
DIQMTQSPSSLSASVGDRVTITCRASENIYSYLAWYQQKPGKAPKLLIYNAKTLAEGVPSRFSGSGSGTDFTLTI
SSLQPEDFATYYCQHHYGTPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC >XENP024532 human IL15Rα(sushi)-human IL15(Q108E; single-chain) x
monalizumab[NKG2A] H1L1

Chain 1 - human_IL15Rα(sushi)_(GGGGS)5-human_IL15(Q108E; single-chain)-Fc
(SEQ ID NO: 936)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVEMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - monalizumab[NKG2A]_H1L1 Fab-Fc Heavy Chain (SEQ ID NO: 937)
QVQLVQSGAEVKKPGASVKVSCKASGYTFTSYWMNWVRQAPGQGLEWMGRIDPYDSETHYAQKLQGRVTMTTDTS
TSTAYMELRSLRSDDTAVYYCARGGYDFDVGTLYWFFDVWGQGTTVTSS/ASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDKKVE
PKSCDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLS
LSPGK Chain 3 - monalizumab[NKG2A]_H1L1 Light Chain (SEQ ID NO: 938)
DIQMTQSPSSLSASVGDRVTITCRASENIYSYLAWYQQKPGKAPKLLIYNAKTLAEGVPSRFSGSGSGTDFTLTI
SSLQPEDFATYYCQHHYGTPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 60B

>XENP027146 human IL15Ra(sushi)_(GGGGS)5-human_IL15(N4D/N65D;single-chain)-monalizumab [NKG2A]_H1L1 IgG1 Fc(216) IgG1 pI(-
) Isosteric A C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)-Fc (SEQ ID NO: 939)
<u>ITCPPPMSVEHADIWVKSYSLYSRERYICNSGFKRKAGTSSLTECVLNKATNVAHWTTPSLKCIR</u>/<u>GGGGSGGGG
SGGGGSGGGGSGGGGS</u>/<u>NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS</u>/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - monalizumab_[NKG2A]_H1L1 Fab-Fc Heavy Chain (SEQ ID NO: 940)
QVQLVQSGAEVKKPGASVKVSCKASGYTFTSYWMNWVRQAPGQGLEWMGRIDPYDSETHYAQKLQGRVTMTTDTS
TSTAYMELRSLRSDDTAVYYCARGGYDFDVGTLYWFFDVWGQGTTVTSS/ASTKGPSVFPLAPSSKSTSGGTAA
LGCLVKDYFPEPVTVSWNSGALTSGVHTFPAVLQSSGLYSLSSVVTVPSSSLGTQTYICNVNHKPSNTKVDKKVE
PKSCDKTHTCPPCPAPPVAGPSVFLFPPKPKDTLMISRTPEVTCVVVDVKHEDPEVKFNWYVDGVEVHNAKTKPR
EEQYNSTYRVVSVLTVLHQDWLNGKEYKCKVSNKALPAPIEKTISKAKGQPREPQVYTLPPSREQMTKNQVKLTC
LVKGFYPSDIAVEWESNGQPENNYKTTPPVLDSDGSFFLYSKLTVDKSRWQQGNVFSCSVMHEALHNHYTQKSLS
LSPGK Chain 3 - monalizumab[NKG2A]_H1L1 Light Chain (SEQ ID NO: 941)
DIQMTQSPSSLSASVGDRVTITCRASENIYSYLAWYQQKPGKAPKLLIYNAKTLAEGVPSRFSGSGSGTDFTLTI
SSLQPEDFATYYCQHHYGTPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 61A

<u>>XENP024533 human IL15Rα(sushi)-human IL15(N65D; single-chain) x
MS[NKG2D]_H0L0</u>

Chain 1 - human_IL15Rα(sushi)_(GGGGS)5-human_IL15(N65D; single-chain)-Fc
(SEQ ID NO: 942)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVNVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - MS[NKG2D]_H0L0 Fab-Fc Heavy Chain (SEQ ID NO: 943)
QVHLQESGPGLVKPSETLSLTCTVSDDSISSYYWSWIRQPPGKGLEWIGHISYSGSANYNPSLKSRVTISVDTSK
NQFSLKLSSVTAADTAVYYCANWDDAFNIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK

Chain 3 - MS[NKG2D]_H0L0 Light Chain (SEQ ID NO: 944)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPWTFGQGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC <u>>XENP024534 human IL15Rα(sushi)-human IL15(Q108E; single-chain) x
MS[NKG2D]_H0L0</u>

Chain 1 - human_IL15Rα(sushi)_(GGGGS)5-human_IL15(Q108E; single-chain)-Fc
(SEQ ID NO: 945)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVEMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - MS[NKG2D]_H0L0 Fab-Fc Heavy Chain (SEQ ID NO: 946)
QVHLQESGPGLVKPSETLSLTCTVSDDSISSYYWSWIRQPPGKGLEWIGHISYSGSANYNPSLKSRVTISVDTSK
NQFSLKLSSVTAADTAVYYCANWDDAFNIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK

Chain 3 - MS[NKG2D]_H0L0 Light Chain (SEQ ID NO: 947)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPWTFGQGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 61B

>XENP027145 human_IL15Ra(sushi)_(GGGGS)5-human_IL15(N4D/N65D;single-chain)-MS[NKG2D]_H0L0_IgG1_Fc(216)_IgG1_pI(-
) Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)-Fc (SEQ ID NO: 948)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - MS[NKG2D]_H0L0 Fab-Fc Heavy Chain (SEQ ID NO: 949)
QVHLQESGPGLVKPSETLSLTCTVSDDSISSYYWSWIRQPPGKGLEWIGHISYSGSANYNPSLKSRVTISVDTSK
NQFSLKLSSVTAADTAVYYCANWDDAFNIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK Chain 3 - MS[NKG2D]_H0L0 Light Chain (SEQ ID NO: 950)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPWTFGQGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 65A

>XENP015076 51.1 H0L0 Heavy Chain
Chain 1 - 51.1_H0L0 Heavy Chain (SEQ ID NO: 951)
QIQLVQSGPELRKPGETVRISCKASGYSFTNFGMIWVKQAPGKGLKWLGWINTYTGEPTYADDLKGRFAFSLETS
ANTAYLKINNFKNEDMATYFCARKDYAGFFDYWGQGTTLTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHYTQKSLSLSPGK Chain 2 - 51.1_H0L0 Light Chain (SEQ ID NO: 952)
DILMTQSPSSMSVSLGDTVSITCHASQDIGSNMGWLQQKPGKSFKALIYHGTNLEYGVPSRFSGSGSGADYSLSI
SSLESEDFADYYCVQFAQFPYTFGGGTSLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP015251 51.1 H1L1 Heavy Chain
Chain 1 - 51.1_H1L1 Heavy Chain (SEQ ID NO: 953)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHYTQKSLSLSPGK Chain 2 - 51.1_H1L1 Light Chain (SEQ ID NO: 954)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP023647 51.1 H1L1 Fab
Chain 1 - 51.1_H1L1_Fab Heavy Chain (SEQ ID NO: 955)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCGS Chain 2 - 51.1_H1L1_Fab Light Chain (SEQ ID NO: 956)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 65B

>XENP024317 one-armed 51.1 H1 L1.60

Chain 1 - 51.1[CD8]_H1_L1.60 Heavy Chain (SEQ ID NO: 957) QIQLVQSGAEVKKPGASVKVSCKASGYSFT<u>NFGMI</u>WVRQAPGQGLEWMG<u>WINTYTGEPTYADGFT</u>GRFVFS
LDTSVNTAYLQISSLKAEDTAVYFCAR<u>KDYAGFFDY</u>WGQGTLVTVSS/ASTKGPSVFPLAPSSKSTSGGTAALGC
LVKDYFPEPVTVSWNSGALTSGVHTFPAVLQSSGLYSLSSVVTVPSSSLGTQTYICNVNHKPSDTKVDKKVEPKS
CDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSP
GK Chain 2 - 51.1[CD8]_H1_L1.60 Light Chain (SEQ ID NO: 958)
DILMTQSPSSLSASVGDRVTITC<u>QASQDIGSDMG</u>WLQQKPGKSFKALIY<u>HGTNLEY</u>GVPSRFSGSGSGADYTLTI
SSLQPEDFATYYC<u>VQFAQFPYT</u>FGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC Chain 3 - empty-Fc (SEQ ID NO: 611)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 66A

>XENP024114 human IL15Rα(sushi)-human IL15(single-chain) x 51.1[CD8] H1L1
Chain 1 - human_IL15Rα(sushi)_GGGGS)5-human_IL15(single-chain)-Fc (SEQ ID
NO: 959)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 51.1[CD8]_H1L1 Fab-Fc Heavy Chain (SEQ ID NO: 960)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Fab-Fc Light Chain (SEQ ID NO: 961)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

**>XENP024115 human IL15Rα(sushi)-human IL15(D61N; single-chain) x
51.1[CD8] H1L1**

Chain 1 - human_IL15Rα(sushi)_(GGGGS)5-human_IL15(D61N; single-chain)-Fc
(SEQ ID NO: 962)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHNTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 51.1[CD8]_H1L1 Fab-Fc Heavy Chain (SEQ ID NO: 963)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Fab-Fc Light Chain (SEQ ID NO: 964)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 66B

>XENP024116 human IL15Rα(sushi)-human IL15(N65D; single-chain) x
51.1[CD8] H1L1

Chain 1 - human_IL15Rα(sushi)_(GGGGS)5-human_IL15(N65D; single-chain)-Fc
(SEQ ID NO: 965)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 51.1[CD8]_H1L1 Fab-Fc Heavy Chain (SEQ ID NO: 966)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Fab-Fc Light Chain (SEQ ID NO: 967)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

- XENP22822 IL15(Q108E)/Rα-Fc heterodimer
- XENP24014 scIL15(N65D)/Rα-Fc
- 24116B scIL15(N65D)/Rα x anti-CD8
- rh IL-15

- XENP22822 IL15(Q108E)/Rα-Fc heterodimer
- XENP24014 scIL15(N65D)/Rα-Fc
- XENP24116 scIL15(N65D)/Rα x anti-CD8
- rh IL-15

Figure 79A

>XENP024543 51.1[CD8] H1L1 bivalent x IL15Rα(sushi)-IL15 (N65D; non-covalent)

Chain 1 - 51.1[CD8]_H1L1_Fab-Fc-Heavy Chain-IL15Rα(sushi) (SEQ ID NO: 968)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK/<u>G
GGGSGGGGS</u>/ITCPPPMSVEHADIWVKSYSLYSRERYICNSGFKRKAGTSSLTECVLNKATNVAHWTTPSLKCIR Chain 2 - 51.1[CD8]_H1L1 Fab-Fc Heavy Chain (SEQ ID NO: 969)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Fab-Fc Light Chain (SEQ ID NO: 970)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC Chain 4 - IL15(N65D) (SEQ ID NO: 670)
<u>NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS</u>

>XENP024546 51.1[CD8] H1L1 IgG1 bivalent x IL15Rα(sushi)-IL15 (single-chain)

Chain 1 - 51.1[CD8]_H1-Fc-IL15Rα(sushi)_(GGGGS)5-IL15(single-chain) (SEQ ID NO: 971)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSDTKVDKKVEPKSCDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSP/<u>GGG
GGSGGGGS</u>/ITCPPPMSVEHADIWVKSYSLYSRERYICNSGFKRKAGTSSLTECVLNKATNVAHWTTPSLKCIR/
<u>GGGGSGGGGSGGGGSGGGGSGGGGS</u>/NWVNVISDLKKIEDLIQSMHIDATLYTESDVHPSCKVTAMKCFLLELQV
ISLESGDASIHDTVENLIILANNSLSSNGNVTESGCKECEELEEKNIKEFLQSFVHIVQMFINTS Chain 2 - 51.1[CD8]_H1L1 Fab-Fc Heavy Chain (SEQ ID NO: 972)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Light Chain (SEQ ID NO: 973)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 79B

>XENP024547 51.1[CD8]_H1L1 bivalent x IL15 N4D/N65D-IL15Rα(sushi)

Chain 1 - 51.1[CD8]_H1-IL15(N4D/N65D)-Fc (SEQ ID NO: 974)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSC/<u>GG
GGSGGGGS</u>/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS/<u>GGGGS</u>/EPKSSDKTHTCPPCPAPPVA
GPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQ
PENNYKTTPPVLDSDGSFFLYSKLTVDKSRWEQGDVFSCSVMHEALHNHYTQKSLSLSPGK Chain 2 - 51.1[CD8]_H1-IL15Rα(sushi)-Fc (SEQ ID NO: 975)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSC/<u>GG
GGSGGGGS</u>/ITCPPPMSVEHADIWVKSYSLYSRERYICNSGFKRKAGTSSLTECVLNKATNVAHWTTPSLKCIR/
<u>GGGGS</u>/EPKSSDKTHTCPPCPAPPVAGPSVFLFPPKPKDTLMISRTPEVTCVVVDVKHEDPEVKFNWYVDGVEVH
NAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVMHEALHNH
YTQKSLSLSPGK Chain 3 - 51.1[CD8]_H1L1 Light Chain (SEQ ID NO: 976)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC >XENP024548 51.1[CD8]_H1L1-IL15Rα(sushi)-IL15 x 51.1_H1L1 Fab Chain 1 - 51.1[CD8]_H1-IL15Rα(sushi)_(GGGGS)5-IL15-Fc (SEQ ID NO: 977)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSC/<u>GG
GGSGGGGS</u>/ITCPPPMSVEHADIWVKSYSLYSRERYICNSGFKRKAGTSSLTECVLNKATNVAHWTTPSLKCIR/
<u>GGGGSGGGGSGGGGSGGGGSGGGGS</u>/NWVDVISDLKKIEDLIQSMHIDATLYTESDVHPSCKVTAMKCFLLELQV
ISLESGDASIHDTVENLIILANNSLSSNGNVTESGCKECEELEEKNIKEFLQSFVHIVQMFINTS/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK Chain 2 - 51.1[CD8]_H1L1 Fab-Fc Heavy Chain (SEQ ID NO: 978)
QIQLVQSGAEVKKPGASVKVSCKASGYSFTNFGMIWVRQAPGQGLEWMGWINTYTGEPTYADGFTGRFVFSLDTS
VNTAYLQISSLKAEDTAVYFCARKDYAGFFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK Chain 3 - 51.1[CD8]_H1L1 Light Chain (SEQ ID NO: 979)
DILMTQSPSSLSASVGDRVTITCQASQDIGSNMGWLQQKPGKSFKALIYHGTNLEYGVPSRFSGSGSGADYTLTI
SSLQPEDFATYYCVQFAQFPYTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC Figures 80A- Figure 80B
Figure 80A
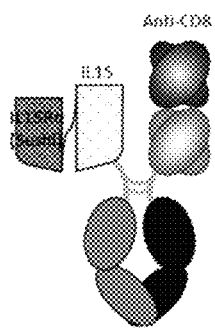
Figure 80B
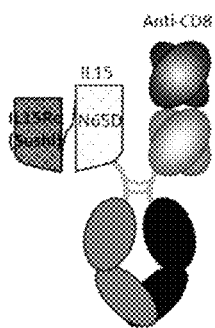

Figures 80C- Figure 80D
Figure 80C
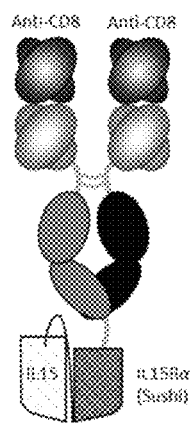
Figure 80D
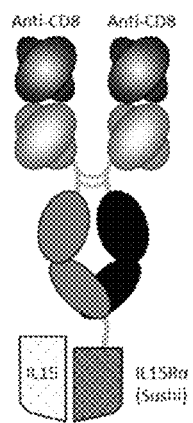

Figures 80E- Figure 80F
Figure 80E
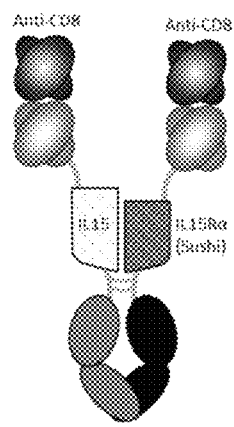
Figure 80F
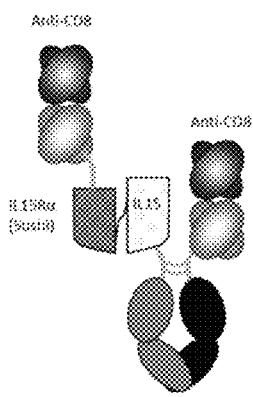

Figure 81

>XENP024025 1C11B3[CD8]
Chain 1 – 1C11B3[CD8]_H1L1 Heavy Chain (SEQ ID NO: 980)
EVQLLESGGGLVQPGGSLRLSCAASGFTFGSYAMSWVRQAPGKGLEWVSTITASGGTTFYADSVKGRFTISRDNS
KNTLYLQMNSLRAEDTAVYYCAKDADGYGAIAFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREEMTKNQVSLTCLVKG
FYPSDIAVEWESNGQPENNYKTTPPVLDSDGSFFLYSKLTVDKSRWQQGNVFSCSVMHEALHNHYTQKSLSLSPG
K

Chain 2 – 1C11B3[CD8]_H1L1 Light Chain (SEQ ID NO: 981)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP024321 one-armed 1C11B3[CD8]_H1L1
Chain 1 – 1C11B3[CD8]_H1L1 Fab-Fc Heavy Chain (SEQ ID NO: 982)
EVQLLESGGGLVQPGGSLRLSCAASGFTFGSYAMSWVRQAPGKGLEWVSTITASGGTTFYADSVKGRFTISRDNS
KNTLYLQMNSLRAEDTAVYYCAKDADGYGAIAFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVKHEDPEVKFNWYVDGVEVHNAKTKPREEEY
NSTYRVVSVLTVLHQDWLNGKEYKCKVSNKALPAPIEKTISKAKGQPREPQVYTLPPSREEMTKNQVSLTCDVSG
FYPSDIAVEWESDGQPENNYKTTPPVLDSDGSFFLYSKLTVDKSRWEQGDVFSCSVMHEALHNHYTQKSLSLSPG
K

Chain 2 – 1C11B3[CD8]_H1L1 Fab-Fc Light Chain (SEQ ID NO: 983)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Chain 3 – empty-Fc (SEQ ID NO: 745)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 87

>XENP24736 human_IL15Ra(sushi)_(GGGGS)5-human_IL15(N4D/N65D;single-Chain)-1C11B3[CD8]_H1L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S (SEQ ID NO: 984)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11B3[CD8]_H1_IgG1_PVA_/S267K/S364K/E357Q Heavy Chain (SEQ ID NO: 985)
EVQLLESGGGLVQPGGSLRLSCAASGFTFGSYAMSWVRQAPGKGLEWVSTITASGGTTFYADSVKGRFTISRDNS
KNTLYLQMNSLRAEDTAVYYCAKDADGYGAIAFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVMHEALHNHYTQKSLSLSPG
K

Chain 3 - 1C11B3[CD8]_L1 Light Chain (SEQ ID NO: 986)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 89

>OKT8_H0.1 (Murine Variable Heavy) (SEQ ID NO: 987)
QVKLQESGAELVKPGASVKLSCTASGFNIKDTYIHFVRQRPEQGLEWIGRIDPANDNTLYASKFQGKATITADTS
SNTAYMHLSSLTSGDTAVYYCGRGYGYYVFDHWGQGTTVTVSS

>OKT8_H1 (Humanized Variable Heavy V1) (SEQ ID NO: 988)
EVQLQQSGAEVKKPGASVKVSCKASGFNIKDTYIHWVRQAPGKGLEWMGRIDPANDNTLYASKFQGRVTITADTS
TNTAYMELSSLRSEDTAVYYCGRGYGYYVFDHWGQGTTVTVSS

>OKT8_H2 (Humanized Variable Heavy V2) (SEQ ID NO: 989)
QVQLVQSGAEVKKPGASVKVSCKASGFNIKDTYIHWVRQAPGKGLEWMGRIDPANDNTLYASKFQGRVTITADTS
INTAYMELSRLRSDDTAVYYCGRGYGYYVFDHWGQGTTVTVSS

>OKT8_L0.1 (Murine Variable Light) (SEQ ID NO: 990)
DIKMTQSPSFLAASPGETITINCRTSRSISQYLAWYQEKPGKTNKLLIYSGSTLQSGIPSRFSGSGSGTDFTLTI
SGLEPEDFAMYYCQQHNENPLTFGAGTKLEIK

>OKT8_L1 (Humanized Variable Light V1) (SEQ ID NO: 991)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK

Figure 90

>XENP15075 OKT8_H1L1_IgG1_PVA_/S267K

XENP15075 Heavy Chain (SEQ ID NO: 992)
EVQLQQSGAEVKKPGASVKVSCKASGFNIKDTYIHWVRQAPGKGLEWMGRIDPANDNTLYASKFQGRVTITADTS
TNTAYMELSSLRSEDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHYTQKSLSLSPGK

XENP15075 Light Chain (SEQ ID NO: 993)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 91

**>XENP24920 empty-Fc-OKT8[CD8]_H2L1_IgG1_Fc(216)_IgG1_pI(-
)_Isosteric_A_C220S/PVA_/S267K/L368D/K370S-IgG1_PVA_/S267K/S364K/E357Q**

Chain 1 - empty_Fc(216)_IgG1_pI(-)_Isosteric_A_C220S/PVA_/S267K/L368D/K370S (SEQ ID NO: 790)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 2 - OKT8[CD8]_H2_IgG1_PVA_/S267K/S364K/E357Q Heavy Chain (SEQ ID NO: 994)
QVQLVQSGAEVKKPGASVKVSCKASGFNIKDTYIHWVRQAPGKGLEWMGRIDPANDNTLYASKFQGRVTITADTS
INTAYMELSRLRSDDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1 Light Chain (SEQ ID NO: 995)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 92A

**>XENP24917 human_IL15Ra(sushi)_(GGGGS)5-human_IL15(N4D/N65D;single-Chain)-
OKT8[CD8]_H1L1_IgG1_Fc(216)_IgG1_pI(-)_Isosteric_A_C220S/PVA_/S267K/L368D/K370S-
IgG1_PVA_/S267K/S364K/E357Q**

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Ra-Fc Chain** (SEQ ID NO: 996)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H1_IgG1_PVA_/S267K/S364K/E357Q Heavy Chain (SEQ ID NO: 997)
EVQLQQSGAEVKKPGASVKVSCKASGFNIKDTYIHWVRQAPGKGLEWMGRIDPANDNTLYASKFQGRVTITADTS
TNTAYMELSSLRSEDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1 Light Chain (SEQ ID NO: 998)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 92B

>XENP24918 human_IL15Ra(sushi)_(GGGGS)5-human_IL15(N4D/N65D;single-Chain)-OKT8[CD8]_H2L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S scIL-15/Ra-Fc Chain (SEQ ID NO: 999)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H2_IgG1_PVA_/S267K/S364K/E357Q Heavy Chain (SEQ ID NO: 1000)
QVQLVQSGAEVKKPGASVKVSCKASGFNIKDTYIHWVRQAPGKGLEWMGRIDPANDNTLYASKFQGRVTITADTS
INTAYMELSRLRSDDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1 Light Chain (SEQ ID NO: 1001)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

>XENP24919 human_IL15Ra(sushi)_(GGGGS)5-human_IL15(N4D/N65D;single-Chain)-OKT8[CD8]_H0.1_L0_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S scIL-15/Ra-Fc Chain (SEQ ID NO: 1002)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H0.1_IgG1_PVA_/S267K/S364K/E357Q Heavy Chain (SEQ ID NO: 1003)
QVKLQESGAELVKPGASVKLSCTASGFNIKDTYIHFVRQRPEQGLEWIGRIDPANDNTLYASKFQGKATITADTS
SNTAYMHLSSLTSGDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_H0.1_L0_IgG1_PVA_/S267K/S364K/E357Q Light Chain (SEQ ID NO: 1004)
DIKMTQSPSFLAASPGETITINCRTSRSISQYLAWYQEKPGKTNKLLIYSGSTLQSGIPSRFSGSGSGTDFTLTI
SGLEPEDFAMYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 92C

>XENP25137 IL15_D30N/E64Q/N65D_(non-covalent)-human_IL15Ra(Sushi)-
OKT8[CD8]_H2L1_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(Sushi)_Fc(216)_IgG1_pI(-)_Isosteric_A_C220S/PVA_/S267K/L368D/K370S IL-15Rα(sushi)-Fc Chain (SEQ ID NO: 1005)
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 – IL15_D30N/E64Q/N65D (SEQ ID NO: 846)
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS

Chain 3 - OKT8[CD8]_H2_IgG1_PVA_/S267K/S364K/E357Q Heavy Chain (SEQ ID NO: 1006)
QVQLVQSGAEVKKPGASVKVSCKASGFNIKDTYIHWVRQAPGKGLEWMGRIDPANDNTLYASKFQGRVTITADTS
INTAYMELSRLRSDDTAVYYCGRGYGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 4 - OKT8[CD8]_L1 Light Chain (SEQ ID NO: 1007)
DIKMTQSPSSLSASVGDRVTITCRTSRSISQYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 95A

>OKT8_H2.152 Variable Heavy (SEQ ID NO: 1008)
QVQLVQSGAEVKKPGASVKVSCKASGFNIKDTYIHWVRQAPGKGLEWMGRIDPDNGETLYASKFQGRVTITADTS
INTAYMELSRLRSDDTAVYYCGRGYGYYVFDHWGQGTTVTVSS >OKT8_H2.153 Variable Heavy (SEQ ID NO: 1009)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGYYVFDHWGQGTTVTVSS >OKT8_H2.154 Variable Heavy (SEQ ID NO: 1010)
QVQLVQSGAEVKKPGASVKVSCKASGFNIKDTYIHWVRQAPGKGLEWMGRIDPDNGETLYASKFQGRVTITADTS
INTAYMELSRLRSDDTAVYYCGRGYGKYVFDHWGQGTTVTVSS >OKT8_H2.155 Variable Heavy (SEQ ID NO: 1011)
QVQLVQSGAEVKKPGASVKVSCKASGFNIKDTYIHWVRQAPGKGLEWMGRIDPDNGETLYASKFQGRVTITADTS
INTAYMELSRLRSDDTAVYYCGRGYGYYYFDHWGQGTTVTVSS >OKT8_H2.156 Variable Heavy (SEQ ID NO: 1012)
QVQLVQSGAEVKKPGASVKVSCKASGFNIKDTYIHWVRQAPGKGLEWMGRIDPDNGETLYASKFQGRVTITADTS
INTAYMELSRLRSDDTAVYYCGRGWGYYVFDHWGQGTTVTVSS >OKT8_H2.157 Variable Heavy (SEQ ID NO: 1013)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGKYVFDHWGQGTTVTVSS >OKT8_H2.158 Variable Heavy (SEQ ID NO: 1014)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGYYYFDHWGQGTTVTVSS >OKT8_H2.159 Variable Heavy (SEQ ID NO: 1015)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGWGYYVFDHWGQGTTVTVSS >OKT8_H2.160 Variable Heavy (SEQ ID NO: 1016)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGYGYYVFDHWGQGTTVTVSS >OKT8_H2.161 Variable Heavy (SEQ ID NO: 1017)
QVQLVQSGAEVKKPGASVKVSCKASGFNIKDTYIHWVRQAPGKGLEWMGRIDPDNDETLYASKFQGRVTITADTS
INTAYMELSRLRSDDTAVYYCGRGYGKYVFDHWGQGTTVTVSS >OKT8_H2.162 Variable Heavy (SEQ ID NO: 1018)
QVQLVQSGAEVKKPGASVKVSCKASGFNIKDTYIHWVRQAPGKGLEWMGRIDPDNDETLYASKFQGRVTITADTS
INTAYMELSRLRSDDTAVYYCGRGYGYYYFDHWGQGTTVTVSS >OKT8_H2.163 Variable Heavy (SEQ ID NO: 1019)
QVQLVQSGAEVKKPGASVKVSCKASGFNIKDTYIHWVRQAPGKGLEWMGRIDPDNDETLYASKFQGRVTITADTS
INTAYMELSRLRSDDTAVYYCGRGWGYYVFDHWGQGTTVTVSS >OKT8_H2.164 Variable Heavy (SEQ ID NO: 1020)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGYGKYVFDHWGQGTTVTVSS

Figure 95B

>OKT8_H2.165 Variable Heavy (SEQ ID NO: 1021)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGYGYYYFDHWGQGTTVTVSS

>OKT8_H2.166 Variable Heavy (SEQ ID NO: 1022)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGWGYYVFDHWGQGTTVTVSS

>OKT8_L1.103 Variable Light (SEQ ID NO: 1023)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK

>OKT8_L1.113 Variable Light (SEQ ID NO: 1024)
AIKMTQSPSSLSASVGDRVTITCRTSRSISIYLAWYQEKPGKTNKLLIYKGSTLQSGIPSRFSGSGSGTDFTLTI
SSLQPEDFATYYCQQANENPLTFGAGTKLEIK

Figure 96

| XENP | Variant | Human CD8 | | | Cyno CD8 | | | $K_D$ hu/cyno |
|---|---|---|---|---|---|---|---|---|
| | | $K_D$ (M) | $k_a$ (1/Ms) | $k_d$ (1/s) | $K_D$ (M) | $k_a$ (1/Ms) | $k_d$ (1/s) | |
| 24920 | H2L1 | 1.20E-08 | 5.00E+05 | 6.00E-03 | 2.02E-07 | 3.47E+05 | 6.99E-02 | 0.06 |
| 26009 | H2.152_L1.103 | 2.44E-09 | 5.06E+05 | 1.23E-03 | 7.76E-08 | 1.17E+05 | 9.09E-03 | 0.03 |
| 26019 | H2.152_L1.113 | 1.60E-09 | 5.58E+05 | 8.92E-04 | 8.07E-08 | 1.19E+05 | 9.62E-03 | 0.02 |
| 26230 | H2.153_L1.103 | 1.74E-09 | 4.82E+05 | 8.39E-04 | 3.92E-08 | 2.47E+05 | 9.67E-03 | 0.04 |
| 26231 | H2.154_L1.103 | 9.55E-08 | 2.36E+05 | 2.26E-02 | 9.59E-08 | 9.25E+04 | 8.87E-03 | 1.00 |
| 26232 | H2.155_L1.103 | 2.25E-09 | 5.73E+05 | 1.29E-03 | 3.57E-08 | 3.19E+05 | 1.14E-02 | 0.06 |
| 26233 | H2.156_L1.103 | 3.49E-09 | 6.34E+05 | 2.21E-03 | 6.66E-08 | 2.00E+05 | 1.33E-02 | 0.05 |
| 26234 | H2.157_L1.103 | 4.82E-08 | 2.58E+05 | 1.24E-02 | 5.56E-08 | 8.06E+04 | 4.48E-03 | 0.87 |
| 26235 | H2.158_L1.103 | 1.38E-09 | 7.18E+05 | 9.92E-04 | 3.35E-08 | 1.43E+05 | 4.77E-03 | 0.04 |
| 26236 | H2.159_L1.103 | 2.49E-09 | 6.80E+05 | 1.69E-03 | 5.51E-08 | 1.22E+05 | 6.72E-03 | 0.05 |
| 26237 | H2.160_L1.103 | 2.27E-09 | 5.07E+05 | 1.15E-03 | 6.74E-08 | 1.14E+05 | 7.67E-03 | 0.03 |
| 26238 | H2.161_L1.103 | 9.66E-08 | 2.71E+05 | 2.62E-02 | 1.07E-07 | 8.39E+04 | 8.94E-03 | 0.91 |
| 26239 | H2.162_L1.103 | 2.57E-09 | 6.82E+05 | 1.75E-03 | 6.66E-08 | 1.33E+05 | 8.82E-03 | 0.04 |
| 26240 | H2.163_L1.103 | 4.43E-09 | 5.98E+05 | 2.65E-03 | 7.54E-08 | 2.98E+05 | 2.25E-02 | 0.06 |
| 26241 | H2.164_L1.103 | 5.56E-08 | 2.65E+05 | 1.48E-02 | 6.70E-08 | 8.80E+04 | 5.89E-03 | 0.83 |
| 26242 | H2.165_L1.103 | 1.88E-09 | 5.91E+05 | 1.11E-03 | 3.00E-08 | 3.22E+05 | 9.68E-03 | 0.06 |
| 26243 | H2.166_L1.103 | 3.14E-09 | 6.26E+05 | 1.96E-03 | 5.59E-08 | 1.92E+05 | 1.08E-02 | 0.06 |

Figure 97A

>XENP26223 human_IL15Ra(sushi)_(GGGGS)5-human_IL15(N4D/N65D;single-Chain)-
OKT8[CD8]_H2.157_L1.103_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Ra-Fc Chain** (SEQ ID NO: 1025)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H2.157_IgG1_PVA_/S267K/S364K/E357Q Heavy Chain (SEQ ID NO: 1026)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGKYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1.103 Light Chain (SEQ ID NO: 1027)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC >XENP26224 human_IL15Ra(sushi)_(GGGGS)5-human_IL15(N4D/N65D;single-Chain)-
OKT8[CD8]_H2.158_L1.103_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Ra-Fc Chain** (SEQ ID NO: 1028)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H2.158_IgG1_PVA_/S267K/S364K/E357Q Heavy Chain (SEQ ID NO: 1029)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGYYYFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1.103 Light Chain (SEQ ID NO: 1030)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 97B

>XENP26227 human_IL15Ra(sushi)_(GGGGS)5-human_IL15(N4D/N65D;single-Chain)-
OKT8[CD8]_H2.164_L1.103_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Ra-Fc Chain** (SEQ ID NO: 1031)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H2.164_IgG1_PVA_/S267K/S364K/E357Q Heavy Chain (SEQ ID NO: 1032)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGYGKYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1.103 Light Chain (SEQ ID NO: 1033)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC >XENP26229 human_IL15Ra(sushi)_(GGGGS)5-human_IL15(N4D/N65D;single-Chain)-
OKT8[CD8]_H2.166_L1.103_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Ra-Fc Chain** (SEQ ID NO: 1034)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - OKT8[CD8]_H2.166_IgG1_PVA_/S267K/S364K/E357Q Heavy Chain (SEQ ID NO: 1035)
QVQLVQSGAEVKKPGASVKVSCKASGFNIKDTYIHWVRQAPGKGLEWMGRIDPDNDETLYASKFQGRVTMTADTS
INTAYMELSRLRSDDTAVYYCGRGWGYYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3 - OKT8[CD8]_L1.103 Light Chain (SEQ ID NO: 1036)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 102

>XENP26585 human_IL15Ra(sushi)_(GGGGS)5-human_IL15(N4D/N65D;single-Chain)-
OKT8[CD8]_H2.157_L1.103_IgG1_Fc(216)_IgG1_pI(-
)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S/M428L/N434S scIL-15/Ra-Fc Chain (SEQ ID NO: 1037)**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - OKT8[CD8]_H2.157_IgG1_PVA_/S267K/S364K/E357Q/M428L/N434S Heavy Chain (SEQ ID NO: 1038)
QVQLVQSGAEVKKPGASVKVSCKASGFNIKDTYIHWVRQAPGKGLEWMGRIDPDNGETLYASKFQGRVTMTADTS
INTAYMELSRLRSDDTAVYYCGRGYGKYVFDHWGQGTTVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK

Chain 3 - OKT8[CD8]_L1.103 Light Chain (SEQ ID NO: 1039)
AIKMTQSPSSLSASVGDRVTITCRTSRSISKYLAWYQEKPGKTNKLLIYSGSTLQSGIPSRFSGSGSGTDFTLTI
SSLQPEDFATYYCQQHNENPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC → (A) PBS + PBS
→ (B) huPBMC + PBS
→ (C) XENP16432 (3.0 mg/kg)
→ (D) XENP26585 (1.0 mg/kg)
→ (E) XENP26585 (1.0 mg/kg) + XENP16432 (3.0 mg/kg)

→ (A) PBS + PBS
→ (B) huPBMC + PBS
→ (C) XENP16432 (3.0 mg/kg)
→ (D) XENP26585 (1.0 mg/kg)
→ (E) XENP26585 (1.0 mg/kg) + XENP16432 (3.0 mg/kg)

Figure 117A

1D7B4[NKG2D]_H1 Variable Heavy (SEQ ID NO: 1040)
EVQLLESGGGLVQPGGSLRLSCAASGFTFSSYAMSWVRQAPGKGLEWVSSISASGGSTYYADSVKGRFTISRDNS
KNTLYLQMNSLRAEDTAVYYCAKGIFSIYFFYFDYWGQGTLVTVSS

1D7B4[NKG2D]_L1 Variable Light (SEQ ID NO: 1041)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK

KYK-1.0[NKG2D]_H1 Variable Heavy (SEQ ID NO: 1042)
EVQLVESGGGVVQPGGSLRLSCAASGFTFSSYGMHWVRQAPGKGLEWVAFIRYDGSNKYYADSVKGRFTISRDNS
KNTKYLQMNSLRAEDTAVYYCAKDRFGYYLDYWGQGTLVTVSS

KYK-1.0[NKG2D]_L1 Variable Light (SEQ ID NO: 1043)
QPVLTQPSSVSVAPGETARIPCGGDDIETKSVHWYQQKPGQAPVLVIYDDDDRPSGIPERFFGSNSGNTATLSIS
RVEAGDEADYYCQVWDDNNDEWVFGGGTQLTVL

KYK-2.0[NKG2D]_H0 Variable Heavy (SEQ ID NO: 1044)
QVQLVESGGGLVKPGGSLRLSCAASGFTFSSYGMHWVRQAPGKGLEWVAFIRYDGSNKYYADSVKGRFTISRDNS
KNTKYLQMNSLRAEDTAVYYCAKDRGLGDGTYFDYWGQGTTVTVSS

KYK-2.0[NKG2D]_L0 Variable Light (SEQ ID NO: 1045)
QSALTQPASVSGSPGQSITISCSGSSSNIGNNAVNWYQQLPGKAPKLLIYYDDLLPSGVSDRFSGSKSGTSAFLA
ISGLQSEDEADYYCAAWDDSLNGPVFGGGTKLTVL

11B2D10[NKG2D]_H0 Variable Heavy (SEQ ID NO: 1046)
QVQLQQSGPELVRPGASVKLSCKASGYTFTSYWMNWVQQRPEQGLEWIGRIDPYDSETHYNQKFKDKAILTVDKS
ASTAYMQLSSLTSEDSAVYYCAKMGDYSFDYWGQGTTVTVSS

11B2D10[NKG2D]_L0 Variable Light (SEQ ID NO: 1047)
DIQLTQSPASLSASVGETVTITCRASGNIHNYLAWYQQKQGKSPQVLVYNAKTLADGVPSRFSGSGSGTQYSLKI
NSLQPEDFGSYYCQHFWSTTWTFGGGTKLEIK

6E5A7[NKG2D]_H0 Variable Heavy (SEQ ID NO: 1048)
QVQLQQSGPGLVQPSQSLSITCTVSGFSLTIYGVHWVRQSPGKGLEWLGVIWSGGSTDYNAAFISRLSISKDNSK
RQVFFKMSSLQANDTAIYYCSRKSHDGYYGVMDYWGQGTTVTVSS

6E5A7[NKG2D]_L0 Variable Light (SEQ ID NO: 1049)
DIQLTQSPAILSVSPGERVSFSCRASQSIGTSIHWYQQRTNGSPRLLIKYASESISGIPSRFSGSGSGTDFTLSI
NGVESEDIADYYCQQSNTWPLTFGAGTKLEIK

6H7E7[NKG2D]_H0 Variable Heavy (SEQ ID NO: 1050)
QVQLQESGPGLVAPSQSLSITCTVSGFSLTSYGVHWIRQPPGKGLEWLGVIWAGGSTNYNSALMSRLSISKDNSK
SQVFLKMNSLQIDDTAMYYCARGGYEGAAWFGYWGQGTTVTVSS

6H7E7[NKG2D]_L0 Variable Light (SEQ ID NO: 1051)
DIQLTQSPAILSASPGEKVTMTCRASSSVSYMHWYQQKPGSSPKPWIYATSNLASGVPARFSGSGSGTSYSLTIS
RVEAEDAATYYCQQWNSNPLTFGAGTKLEIK mAb E[NKG2D]_H1 Variable Heavy (SEQ ID NO: 1052)
EVQLVESGGGLVKPGGSLRLSCAASGFTFSSYSMNWVRQAPGKGLEWVSSITSSSSYIYYADSVKGRFTISRDNA
KNSLYLQMNSLRAEDTAVYYCARDRRYFDWFPLDYRGQGTLVTVSS mAb E[NKG2D]_L1 Variable Light (SEQ ID NO: 1053)
DIQMTQSPSSLSASVGDRVTITCRASQGISSWLAWYQQKPEKAPKSLIYAASSLQSGVPSRFSGSGSGTDFTLTI
SSLQPEDFATYYCQQYNGYPYTFGQGTKLEIK

16F31[NKG2D]_H1 Variable Heavy (SEQ ID NO: 1054)
EVQLVESGGGVVRPGGSLRLSCAASGFTFDDYGMTWVRQAPGKGLEWVSGINWNGGSTGYADSVKGRFTISRDNA
KNSLYLQMNSLRAEDTALYYCARERELYYYYGLDVWGQGTTVTVSS

16F31[NKG2D]_L1 Variable Light(SEQ ID NO: 1055)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPFTFGPGTKVDIKR

Figure 117B mAb D[NKG2D]_H1 Variable Heavy (SEQ ID NO: 1056)
QVQLVQSGAEVKKPGASVKVSCKASGYTFTNYWMHWVRQAPGQGLEWMGEIDPSDIYTNYAQKFQGRVTMTRDTS
TSTVYMELSSLRSEDTAVYYCARGIYDGYYVYGMDYWGQGTTVTVSS mAb D[NKG2D]_L1 Variable Light (SEQ ID NO: 1057)
YIQMTQSPSSLSASVGDRVTITCRSSQDISNYLNWYQQKPGKAPKLLIYYTSRLHSGVPSRFSGSGSGTDFTFTI
SSLQPEDIATYYCQQGKTLPRTFGGGTKVEIK

1D7B4[NKG2D]_H1 Variable Heavy (SEQ ID NO: 1058)
EVQLLESGGGLVQPGGSLRLSCAASGFTFSSYAMSWVRQAPGKGLEWVSSISASGGSTYYADSVKGRFTISRDNS
KNTLYLQMNSLRAEDTAVYYCAKGIFSIYFFYFDYWGQGTLVTVSS

1D7B4[NKG2D]_L1 Variable Light (SEQ ID NO: 1059)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK mAb A[NKG2D]_H1 Variable Heavy (SEQ ID NO: 1060)
QVQLVQSGAEVKKPGASVKVSCKVSGFSLTSYGVHWIRQAPGQGLEWMGVIWAGGSTNYNSKFQGRVTMTKDNSK
STVYMELSSLRSEDTAVYYCARGGYEGAAWFGYWGQGTLVTVSS mAb A[NKG2D]_H2 Variable Heavy (SEQ ID NO: 1061)
QVQLQESGPGLVKPSETLSLTCTVSGFSLTSYGVHWIRQPPGKGLEWIGVIWAGGSTNYNPSLKSRVTISKDNSK
SQVSLKLSSVTAADTAVYYCARGGYEGAAWFGYWGQGTLVTVSS mAb A[NKG2D]_L1 Variable Light (SEQ ID NO: 1062)
DIQLTQSPSSLSASVGDRVTITCRASSSVSYMHWYQQKPGKSPKPLIYATSNLASGVPARFSGSGSGTDYTLTIS
SLQPEDFATYYCQQWNSNPLTFGAGTKVEIK mAb A[NKG2D]_L2 Variable Light (SEQ ID NO: 1063)
DIQLTQSPATLSLSPGERATLSCRASSSVSYMHWYQQKPGQSPRPLIYATSNLASGVPARFSGSGSGTDYTLTIS
SLEPEDFAVYYCQQWNSNPLTFGAGTKVEIK mAb B[NKG2D]_H1 Variable Heavy (SEQ ID NO: 1064)
QVQLVQSGAEVKKPGASVKVSCKASGYTFTSYWMNWVRQAPGQGLEWMGRIDPYDSETHYNQKFQGRVTMTVDKS
TSTAYMELSSLRSEDTAVYYCAKMGDYSFDYWGQGTLVTVSS mAb B[NKG2D]_H2 Variable Heavy (SEQ ID NO: 1065)
EVQLVQSGAEVKKPGESLRISCKASGYTFTSYWMNWVRQMPGKGLEWMGRIDPYDSETHYNPSFQGHVTISVDKS
ISTAYLQWSSLKASDTAMYYCAKMGDYSFDYWGQGTLVTVSS mAb B[NKG2D]_H3 Variable Heavy (SEQ ID NO: 1066)
EVQLVESGGGLVQPGGSLRLSCAASGYTFTSYWMNWVRQAPGKGLVWVSRIDPYDSETHYNQKVKGRFTISVDKA
KSTAYLQMNSLRAEDTAVYYCAKMGDYSFDYWGQGTLVTVSS mAb B[NKG2D]_L1 Variable Light (SEQ ID NO: 1067)
DIQLTQSPSSLSASVGDRVTITCRASGNIHNYLAWYQQKPGKSPKVLVYNAKTLADGVPSRFSGSGSGTDYTLTI
SSLQPEDFATYYCQHFWSTTWTFGGGTKVEIK mAb B[NKG2D]_L1.1 Variable Light (SEQ ID NO: 1068)
DIQLTQSPSSLSASVGDRVTITCRASGNIHNYLAWYQQKPGKSPKVLVYNAKTLADGVPSRFSGSGSGTDYTLTI
SSLQPEDFATYYCQHFWSTPWTFGGGTKVEIK mAb B[NKG2D]_L2 Variable Light (SEQ ID NO: 1069)
DIQLTQSPDSLAVSLGERATINCKASGNIHNYLAWYQQKPGQSPKVLVYNAKTLADGVPSRFSGSGSGTDYTLTI
SSLQAEDVAVYYCQHFWSTTWTFGGGTKVEIK

Figure 117C mAb C[NKG2D]_H1 Variable Heavy (SEQ ID NO: 1070)
EVQLVESGGGLVQPGGSLRLSCAVSGFSLTIYGVHWVRQAPGKGLEWVSVIWSGGSTDYNAKVKGRFTISKDNSK
RTVYLQMNSLRAEDTAVYYCSRKSHDGYYGVMDYWGQGTTVTVSS mAb C[NKG2D]_H2 Variable Heavy(SEQ ID NO: 1071)
QVQLVQSGAEVKKPGASVKVSCKVSGFSLTIYGVHWVRQAPGQGLEWMGVIWSGGSTDYNAKFQGRVTMTKDNSK
RTVYMELSSLRSEDTAVYYCSRKSHDGYYGVMDYWGQGTTVTVSS mAb C[NKG2D]_L1 Variable Light (SEQ ID NO: 1072)
DIQLTQSPDFQSVTPKEKVTITCRASQSIGTSIHWYQQKPDQSPKLLIKYASESISGIPSRFSGSGSGTDFTLTI
NSLEAEDAATYYCQQSNTWPLTFGAGTKVEIK mAb C[NKG2D]_L2 Variable Light (SEQ ID NO: 1073)
DIQLTQSPSSLSASVGDRVTITCRASQSIGTSIHWYQQKPGKSPKLLIKYASESISGIPSRFSGSGSGTDFTLTI
SSLQPEDFATYYCQQSNTWPLTFGAGTKVEIK

Figure 118

>XENP27055 1D7B4[NKG2D]_H1L1_IgG1_PVA_/S267K

Heavy Chain - 1D7B4[NKG2D]_H1_IgG1_PVA_/S267K (SEQ ID NO: 1074)
EVQLLESGGGLVQPGGSLRLSCAASGFTFSSYAMSWVRQAPGKGLEWVSSISASGGSTYYADSVKGRFTISRDNS
KNTLYLQMNSLRAEDTAVYYCAKGIFSIYFFYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREEMTKNQVSLTCLVKG
FYPSDIAVEWESNGQPENNYKTTPPVLDSDGSFFLYSKLTVDKSRWQQGNVFSCSVMHEALHNHYTQKSLSLSPG
K Light Chain - 1D7B4[NKG2D]_L1 SEQ ID NO: 1075)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 119

> XENP25379 human NKG2D antigen
HHHHHHGGGGSGLNDIFEAQKIEWHEGGSEPKSSDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGKGGSENLYFQGGGGGSNSLFNQEVQIPLTESYCGPCPKNW
ICYKNNCYQFFDESKNWYESQASCMSQNASLLKVYSKEDQDLLKLVKSYHWMGLVHIPTNGSWQWEDGSILSPNL
LTIIEMQKGDCALYASSFKGYIENCSTPNTYICMQRTV (SEQ ID NO: 1076)

> XENP25380 cynomolgus NKG2D antigen
HHHHHHGGGGSGLNDIFEAQKIEWHEGGSEPKSSDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGKGGSENLYFQGGGGGSNSLFNQEVQIPLTESYCGPCPKNW
ICYKNNCYQFFNESKNWYESQASCMSQNASLLKVYSKEDQDLLKLVKSYHWMGLVHIPTNGSWQWEDGSILSPNL
LTIIEMQKGDCALYASSFKGYIENCSIPNTYICMQRTV (SEQ ID NO: 1077)

> XENP22490 empty-Fc_IgG1
EPKSSDKTHTCPPCPAPELLGGPSVFLFPPKPKDTLMISRTPEVTCVVVDVSHEDPEVKFNWYVDGVEVHNAKTK
PREEQYNSTYRVVSVLTVLHQDWLNGKEYKCKVSNKALPAPIEKTISKAKGQPREPQVYTLPPSREEMTKNQVSL
TCLVKGFYPSDIAVEWESNGQPENNYKTTPPVLDSDGSFFLYSKLTVDKSRWQQGNVFSCSVMHEALHNHYTQKS
LSLSPGKGSHHHHHHGGGGSGLNDIFEAQKIEWHEG (SEQ ID NO: 1078)

Figure 122A

>XENP27195 human_IL15Ra(sushi)_(GGGGS)5-human_IL15(N4D/N65D;single-chain)-KYK-
2.0[NKG2D]_H0L0_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1079)

Chain 2 - KYK-2.0[NKG2D]_H0_IgG1_Fc(216)_IgG1_PVA_/S267K/S364K/E357Q
QVQLVESGGGLVKPGGSLRLSCAASGFTFSSYGMHWVRQAPGKGLEWVAFIRYDGSNKYYADSVKGRFTISRDNS
KNTKYLQMNSLRAEDTAVYYCAKDRGLGDGTYFDYWGQGTTVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVMHEALHNHYTQKSLSLSPG
K (SEQ ID NO: 1080)

Chain 3 - KYK-2.0[NKG2D]_L0
QSALTQPASVSGSPGQSITISCSGSSSNIGNNAVNWYQQLPGKAPKLLIYYDDLLPSGVSDRFSGSKSGTSAFLA
ISGLQSEDEADYYCAAWDDSLNGPVFGGGTKLTVL/GQPKAAPSVTLFPPSSEELQANKATLVCLISDFYPGAVT
VAWKADSSPVKAGVETTTPSKQSNNKYAASSYLSLTPEQWKSHRSYSCQVTHEGSTVEKTVAPTECS (SEQ ID
NO: 1081)

>XENP27197 human_IL15Ra(sushi)_(GGGGS)5-human_IL15(N4D/N65D;single-chain)-
1D7B4[NKG2D]_H1L1_IgG1_Fc(216)_IgG1_pI(-
)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S/M428L/N434S**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK (SEQ ID NO:
1082)

Chain 2 - 1D7B4[NKG2D]_H1_IgG1_PVA_/S267K/S364K/E357Q/M428L/N434S
EVQLLESGGGLVQPGGSLRLSCAASGFTFSSYAMSWVRQAPGKGLEWVSSISASGGSTYYADSVKGRFTISRDNS
KNTLYLQMNSLRAEDTAVYYCAKGIFSIYFFYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVLHEALHSHYTQKSLSLSPG
K (SEQ ID NO: 1083)

Chain 3 - 1D7B4[NKG2D]_L1
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1084)

Figure 122B

>XENP27615 human_IL15Ra(sushi)_(GGGGS)5-human_IL15(N4D/N65D;single-chain)-
11B2D10[NKG2D]_H0L0_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1085)

**Chain 2 - 11B2D10[NKG2D]_H0_IgG1_pI(-)_Isosteric_A_C220S/PVA_/S267K/L368D/K370S-
IgG1_PVA_/S267K/S364K/E357Q**

QVQLQQSGPELVRPGASVKLSCKASGYTFT<u>SYWMN</u>WVQQRPEQGLEWIG<u>RIDPYDSETHYNQKFKD</u>KAILTVDKS
ASTAYMQLSSLTSEDSAVYYCAK<u>MGDYSFDY</u>WGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1086)

Chain 3 - 11B2D10[NKG2D]_L0

DIQLTQSPASLSASVGETVTITC<u>RASGNIHNY</u>LAWYQQKQGKSPQVLVY<u>NAKTLAD</u>GVPSRFSGSGSGTQYSLKI
NSLQPEDFGSYYC<u>QHFWSTTWT</u>FGGGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC(SEQ ID
NO: 1087)

>XENP27616 human_IL15Ra(sushi)_(GGGGS)5-human_IL15(N4D/N65D;single-chain)-
6E5A7[NKG2D]_H0L0_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1088)

**Chain 2 - 6E5A7[NKG2D]_H0_IgG1_pI(-)_Isosteric_A_C220S/PVA_/S267K/L368D/K370S-
IgG1_PVA_/S267K/S364K/E357Q**

QVQLQQSGPGLVQPSQSLSITCTVSGFSLT<u>IYGVH</u>WVRQSPGKGLEWLGV<u>IWSGGSTDYNAAFIS</u>RLSISKDNSK
RQVFFKMSSLQANDTAIYYCSR<u>KSHDGYYGVMDY</u>WGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 1089)

Chain 3 - 6E5A7[NKG2D]_L0
DIQLTQSPAILSVSPGERVSFSC<u>RASQSIGTS</u>IHWYQQRTNGSPRLLIK<u>YASESIS</u>GIPSRFSGSGSGTDFTLSI
NGVESEDIADYYC<u>QQSNTWPLT</u>FGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1090)

Figure 122C

>XENP27617 human_IL15Ra(sushi)_(GGGGS)5-human_IL15(N4D/N65D;single-chain)-6H7E7[NKG2D]_H0L0_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK(SEQ ID NO: 1091)

Chain 2 - 6H7E7[NKG2D]_H0_IgG1_pI(-)_Isosteric_A_C220S/PVA_/S267K/L368D/K370S-IgG1_PVA_/S267K/S364K/E357Q

QVQLQESGPGLVAPSQSLSITCTVSGFSLTSYGVHWIRQPPGKGLEWLGVIWAGGSTNYNSALMSRLSISKDNSK
SQVFLKMNSLQIDDTAMYYCARGGYEGAAWFGYWGQGTTVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK(
SEQ ID NO: 1092)

Chain 3 - 6H7E7[NKG2D]_L0

DIQLTQSPAILSASPGEKVTMTCRASSSVSYMHWYQQKPGSSPKPWIYATSNLASGVPARFSGSGSGTSYSLTIS
RVEAEDAATYYCQQWNSNPLTFGAGTKLEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC(SEQ ID NO: 1093)

>XENP27618 human_IL15Ra(sushi)_(GGGGS)5-human_IL15(N4D/N65D;single-chain)-mAb E[NKG2D]_H1L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK(SEQ ID NO: 1094)

Chain 2 - mAb E[NKG2D]_H1_IgG1_pI(-)_Isosteric_A_C220S/PVA_/S267K/L368D/K370S-IgG1_PVA_/S267K/S364K/E357Q

EVQLVESGGGLVKPGGSLRLSCAASGFTFSSYSMNWVRQAPGKGLEWVSSITSSSSYIYYADSVKGRFTISRDNA
KNSLYLQMNSLRAEDTAVYYCARDRRYFDWFPLDYRGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVMHEALHNHYTQKSLSLSPG
K(SEQ ID NO: 1095)

Chain 3 - mAb E[NKG2D]_L1

DIQMTQSPSSLSASVGDRVTITCRASQGISSWLAWYQQKPEKAPKSLIYAASSLQSGVPSRFSGSGSGTDFTLTI
SSLQPEDFATYYCQQYNGYPYTFGQGTKLEIKR/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC
(SEQ ID NO: 1096)

Figure 122D

>XENP27619 human_IL15Ra(sushi)_(GGGGS)5-human_IL15(N4D/N65D;single-chain)-
16F31[NKG2D]_H1L1_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/<u>GGGGSGGGGSGGG
GSGGGGSGGGGS</u>/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK (SEQ ID NO: 1097)

Chain 2 - 16F31[NKG2D]_H1_IgG1_pI(-)_Isosteric_A_C220S/PVA_/S267K/L368D/K370S-IgG1_PVA_/S267K/S364K/E357Q

EVQLVESGGGVVRPGGSLRLSCAASGFTFD<u>DYGMT</u>WVRQAPGKGLEWVS<u>GINWNGGSTGYADSVKG</u>RFTISRDNAKNSL
YLQMNSLRAEDTALYYCAR<u>ERELYYYYGLD</u>VWGQGTTVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSNTKVDKKVEPKSCDKTHTCPPCPA
PPVAGPSVFLFPPKPKDTLMISRTPEVTCVVVDVKHEDPEVKFNWYVDGVEVHNAKTKPREEQYNSTYRVVSVLTVLHQ
DWLNGKEYKCKVSNKALPAPIEKTISKAKGQPREPQVYTLPPSREQMTKNQVKLTCLVKGFYPSDIAVEWESNGQPENN
YKTTPPVLDSDGSFFLYSKLTVDKSRWQQGNVFSCSVMHEALHNHYTQKSLSLSPGK (SEQ ID NO: 1098)

Chain 3 - 16F31[NKG2D]_L1

EIVLTQSPGTLSLSPGERATLSC<u>RASQSVSSSY</u>LAWYQQKPGQAPRLLIY<u>GASSRAT</u>GIPDRFSGSGSGTDFTLTISRL
EPEDFAVYYC<u>QQYGSSPFT</u>FGPGTKVDIKR/RTVAAPSVFIFPPSDEQLKSGTASVVCLLNNFYPREAKVQWKVDNALQ
SGNSQESVTEQDSKDSTYSLSSTLTLSKADYEKHKVYACEVTHQGLSSPVTKSFNRGEC (SEQ ID NO: 1099)

>XENP27620 human_IL15Ra(sushi)_(GGGGS)5-human_IL15(N4D/N65D;single-chain)-mAb
D[NKG2D]_H1L1_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/<u>GGGGSGGGGSGGG
GSGGGGSGGGGS</u>/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK (SEQ ID NO: 1100)

Chain 2 - mAb D[NKG2D]_H1_IgG1_pI(-)_Isosteric_A_C220S/PVA_/S267K/L368D/K370S-IgG1_PVA_/S267K/S364K/E357Q

QVQLVQSGAEVKKPGASVKVSCKASGYTFT<u>NYWMH</u>WVRQAPGQGLEWMGE<u>IDPSDIYTNYAQKFQG</u>RVTMTRDTSTSTV
YMELSSLRSEDTAVYYCAR<u>GIYDGYYVYGMDY</u>WGQGTTVTVSS/ASTKGPSVFPLAPSSKSTSGGTAALGCLVKDYFPE
PVTVSWNSGALTSGVHTFPAVLQSSGLYSLSSVVTVPSSSLGTQTYICNVNHKPSNTKVDKKVEPKSCDKTHTCPPCPA
PPVAGPSVFLFPPKPKDTLMISRTPEVTCVVVDVKHEDPEVKFNWYVDGVEVHNAKTKPREEQYNSTYRVVSVLTVLHQ
DWLNGKEYKCKVSNKALPAPIEKTISKAKGQPREPQVYTLPPSREQMTKNQVKLTCLVKGFYPSDIAVEWESNGQPENN
YKTTPPVLDSDGSFFLYSKLTVDKSRWQQGNVFSCSVMHEALHNHYTQKSLSLSPGK (SEQ ID NO: 1101)

Chain 3 - mAb D[NKG2D]_L1

YIQMTQSPSSLSASVGDRVTITC<u>RSSQDISNYLN</u>WYQQKPGKAPKLLIYY<u>TSRLHSG</u>VPSRFSGSGSGTDFTFTISSLQ
PEDIATYYC<u>QQGKTLPRT</u>FGGGTKVEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC (SEQ ID NO: 1102)

Figure 122E

>XENP27621 human_IL15Ra(sushi)_(GGGGS)5-human_IL15(N4D/N65D;single-chain)-KYK-
1.0[NKG2D]_H1L1_IgG1_Fc(216)_IgG1_pI(-)_Isosteric_A_C220S/PVA_/S267K/L368D/K370S-
IgG1_PVA_/S267K/S364K/E357Q Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S ITCPPPMSVEHADIWVKSYSLYSRERYICNSGFKRKAGTSSLTECVLNKATNVAHWTTPSLKCIR/<u>GGGGSGGGGSGGG
GSGGGGSGGGGS</u>/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK(SEQ ID NO: 1103)

Chain 2 - KYK-1.0[NKG2D]_H1_IgG1_pI(-)_Isosteric_A_C220S/PVA_/S267K/L368D/K370S-
IgG1_PVA_/S267K/S364K/E357Q EVQLVESGGGVVQPGGSLRLSCAASGFTFSS<u>YGMH</u>WVRQAPGKGLEWVAF<u>IRYDGSNKYYADSVKG</u>RFTISRDNSKNTK
YLQMNSLRAEDTAVYYCAK<u>DRFGYYLDY</u>WGQGTLVTVSS/ASTKGPSVFPLAPSSKSTSGGTAALGCLVKDYFPEPVTV
SWNSGALTSGVHTFPAVLQSSGLYSLSSVVTVPSSSLGTQTYICNVNHKPSNTKVDKKVEPKSCDKTHTCPPCPAPPVA
GPSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGK(SEQ ID NO: 1104)

Chain 3 - KYK-1.0[NKG2D]_L1

QPVLTQPSSVSVAPGETARIPC<u>GGDDIETKSV</u>HWYQQKPGQAPVLVIY<u>DDDDRPS</u>GIPERFFGSNSGNTATLSISRVEA
GDEADYYC<u>QVWDDNNDEWV</u>FGGGTQLTVL/GQPKAAPSVTLFPPSSEELQANKATLVCLISDFYPGAVTVAWKADSSPV
KAGVETTTPSKQSNNKYAASSYLSLTPEQWKSHRSYSCQVTHEGSTVEKTVAPTECS(SEQ ID NO: 1105)

>XENP27622 human_IL15Ra(sushi)_(GGGGS)5-human_IL15(N4D/N65D;single-chain)-mAb
B[NKG2D]_H1L1_IgG1_Fc(216)_IgG1_pI(-)_Isosteric_A_C220S/PVA_/S267K/L368D/K370S-
IgG1_PVA_/S267K/S364K/E357Q Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S ITCPPPMSVEHADIWVKSYSLYSRERYICNSGFKRKAGTSSLTECVLNKATNVAHWTTPSLKCIR/<u>GGGGSGGGGSGGG
GSGGGGSGGGGS</u>/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK(SEQ ID NO: 1106)

Chain 2 - mAb B[NKG2D]_H1_IgG1_pI(-)_Isosteric_A_C220S/PVA_/S267K/L368D/K370S-
IgG1_PVA_/S267K/S364K/E357Q QVQLVQSGAEVKKPGASVKVSCKASGYTFTS<u>YWMN</u>WVRQAPGQGLEWMG<u>RIDPYDSETHYNQKFQG</u>RVTMTVDKSTSTA
YMELSSLRSEDTAVYYCAK<u>MGDYSFDY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLNG
KEYKCKVSNKALPAPIEKTISKAKGQPREPQVYTLPPSREQMTKNQVKLTCLVKGFYPSDIAVEWESNGQPENNYKTTP
PVLDSDGSFFLYSKLTVDKSRWQQGNVFSCSVMHEALHNHYTQKSLSLSPGK(SEQ ID NO: 1107)

Chain 3 - mAb B[NKG2D]_L1

DIQLTQSPSSLSASVGDRVTITC<u>RASGNIHNYLA</u>WYQQKPGKSPKVLVY<u>NAKTLAD</u>GVPSRFSGSGSGTDYTLTISSLQ
PEDFATYYC<u>QHFWSTTWT</u>FGGGTKVEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC(SEQ ID NO: 1108)

Figure 122F

>XENP27623 human_IL15Ra(sushi)_(GGGGS)5-human_IL15(N4D/N65D;single-chain)-mAb
B[NKG2D]_H1_L1.1_IgG1_Fc(216)_IgG1_pI(-)_Isosteric_A_C220S/PVA_/S267K/L368D/K370S-
IgG1_PVA_/S267K/S364K/E357Q Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIR/GGGGSGGGGSGGG
GSGGGGSGGGGS/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK (SEQ ID NO: 1109)

Chain 2 - mAb B[NKG2D]_H1__IgG1_pI(-)_Isosteric_A_C220S/PVA_/S267K/L368D/K370S-
IgG1_PVA_/S267K/S364K/E357Q
EVQLVESGGGLVQPGGSLRLSCAVSGFSLTIYGVHWVRQAPGKGLEWVSVIWSGGSTDYNAKVKGRFTISKDNSKRTVY
LQMNSLRAEDTAVYYCSRKSHDGYYGVMDYWGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK
(SEQ ID NO: 1110)

Chain 3 - mAb B[NKG2D]_L1.1
DIQLTQSPSSLSASVGDRVTITCRASGNIHNYLAWYQQKPGKSPKVLVYNAKTLADGVPSRFSGSGSGTDYTLTISSLQ
PEDFATYYCQHFWSTPWTFGGGTKVEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC(SEQ ID NO: 1111)

>XENP27624 human_IL15Ra(sushi)_(GGGGS)5-human_IL15(N4D/N65D;single-chain)-mAb
B[NKG2D]_H1L2_IgG1_Fc(216)_IgG1_pI(-)_Isosteric_A_C220S/PVA_/S267K/L368D/K370S-
IgG1_PVA_/S267K/S364K/E357Q Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIR/GGGGSGGGGSGGG
GSGGGGSGGGGS/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK (SEQ ID NO: 1112)

Chain 2 - mAb B[NKG2D]_H1_IgG1_pI(-)_Isosteric_A_C220S/PVA_/S267K/L368D/K370S-
IgG1_PVA_/S267K/S364K/E357Q
QVQLVQSGAEVKKPGASVKVSCKVSGFSLTSYGVHWIRQAPGQGLEWMGVIWAGGSTNYNSKFQGRVTMTKDNSKSTVY
MELSSLRSEDTAVYYCARGGYEGAAWFGYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK (SEQ ID NO: 1113)

Chain 3 - mAb B[NKG2D]_L2
DIQLTQSPDSLAVSLGERATINCKASGNIHNYLAWYQQKPGQSPKVLVYNAKTLADGVPSRFSGSGSGTDYTLTISSLQ
AEDVAVYYCQHFWSTTWTFGGGTKVEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC (SEQ ID NO: 1114)

Figure 122G

<u>>XENP27625 human_IL15Ra(sushi)_(GGGGS)5-human_IL15(N4D/N65D;single-chain)-mAb B[NKG2D]_H2L1_IgG1_Fc(216)_IgG1_pI(-)_Isosteric_A_C220S/PVA_/S267K/L368D/K370S-IgG1_PVA_/S267K/S364K/E357Q</u>

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/<u>GGGGSGGGG SGGGGSGGGGSGGGGS</u>/NWVDVISDLKKIEDLIQSMHIDATLYTESDVHPSCKVTAMKCFLLELQVISLESGDAS IHDTVEDLIILANNSLSSNGNVTESGCKECEELEEKNIKEFLQSFVHIVQMFINTS/EPKSSDKTHTCPPCPAPP VAGPSVFLFPPKPKDTLMISRTPEVTCVVVDVKHEDPEVKFNWYVDGVEVHNAKTKPREEEYNSTYRVVSVLTVL HQDWLNGKEYKCKVSNKALPAPIEKTISKAKGQPREPQVYTLPPSREEMTKNQVSLTCDVSGFYPSDIAVEWESD GQPENNYKTTPPVLDSDGSFFLYSKLTVDKSRWEQGDVFSCSVMHEALHNHYTQKSLSLSPGK (SEQ ID NO: 1115)

Chain 2 - mAb B[NKG2D]_H2_IgG1_pI(-)_Isosteric_A_C220S/PVA_/S267K/L368D/K370S-IgG1_PVA_/S267K/S364K/E357Q

EVQLVQSGAEVKKPGESLRISCKASGYTFT<u>SYWMN</u>WVRQMPGKGLEWMG<u>RIDPYDSETHYNPSFQ</u>GHVTISVDKS ISTAYLQWSSLKASDTAMYYCAK<u>MGDYSFDY</u>WGQGTLVTVSS/ASTKGPSVFPLAPSSKSTSGGTAALGCLVKDY FPEPVTVSWNSGALTSGVHTFPAVLQSSGLYSLSSVVTVPSSSLGTQTYICNVNHKPSNTKVDKKVEPKSCDKTH TCPPCPAPPVAGPSVFLFPPKPKDTLMISRTPEVTCVVVDVKHEDPEVKFNWYVDGVEVHNAKTKPREEQYNSTY RVVSVLTVLHQDWLNGKEYKCKVSNKALPAPIEKTISKAKGQPREPQVYTLPPSREQMTKNQVKLTCLVKGFYPS DIAVEWESNGQPENNYKTTPPVLDSDGSFFLYSKLTVDKSRWQQGNVFSCSVMHEALHNHYTQKSLSLSPGK (SEQ ID NO: 1116)

Chain 3 - mAb B[NKG2D]_L1

DIQLTQSPSSLSASVGDRVTITC<u>RASGNIHNYLA</u>WYQQKPGKSPKVLVY<u>NAKTLAD</u>GVPSRFSGSGSGTDYTLTI SSLQPEDFATYYC<u>QHFWSTTWTF</u>GGGTKVEIK/RTVAAPSVFIFPPSDEQLKSGTASVVCLLNNFYPREAKVQWK VDNALQSGNSQESVTEQDSKDSTYSLSSTLTLSKADYEKHKVYACEVTHQGLSSPVTKSFNRGEC(SEQ ID NO: 1117)

<u>>XENP27626 human_IL15Ra(sushi)_(GGGGS)5-human_IL15(N4D/N65D;single-chain)-mAb B[NKG2D]_H2_L1.1_IgG1_Fc(216)_IgG1_pI(-)_Isosteric_A_C220S/PVA_/S267K/L368D/K370S-IgG1_PVA_/S267K/S364K/E357Q</u>

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIR/<u>GGGGSGGGG SGGGGSGGGGSGGGGS</u>/NWVDVISDLKKIEDLIQSMHIDATLYTESDVHPSCKVTAMKCFLLELQVISLESGDAS IHDTVEDLIILANNSLSSNGNVTESGCKECEELEEKNIKEFLQSFVHIVQMFINTS/EPKSSDKTHTCPPCPAPP VAGPSVFLFPPKPKDTLMISRTPEVTCVVVDVKHEDPEVKFNWYVDGVEVHNAKTKPREEEYNSTYRVVSVLTVL HQDWLNGKEYKCKVSNKALPAPIEKTISKAKGQPREPQVYTLPPSREEMTKNQVSLTCDVSGFYPSDIAVEWESD GQPENNYKTTPPVLDSDGSFFLYSKLTVDKSRWEQGDVFSCSVMHEALHNHYTQKSLSLSPGK (SEQ ID NO: 1118)

Chain 2 - mAb B[NKG2D]_H2__IgG1_pI(-)_Isosteric_A_C220S/PVA_/S267K/L368D/K370S-IgG1_PVA_/S267K/S364K/E357Q

EVQLVQSGAEVKKPGESLRISCKASGYTFT<u>SYWMN</u>WVRQMPGKGLEWMG<u>RIDPYDSETHYNPSFQ</u>GHVTISVDKS ISTAYLQWSSLKASDTAMYYCAK<u>MGDYSFDY</u>WGQGTLVTVSS/ASTKGPSVFPLAPSSKSTSGGTAALGCLVKDY FPEPVTVSWNSGALTSGVHTFPAVLQSSGLYSLSSVVTVPSSSLGTQTYICNVNHKPSNTKVDKKVEPKSCDKTH TCPPCPAPPVAGPSVFLFPPKPKDTLMISRTPEVTCVVVDVKHEDPEVKFNWYVDGVEVHNAKTKPREEQYNSTY RVVSVLTVLHQDWLNGKEYKCKVSNKALPAPIEKTISKAKGQPREPQVYTLPPSREQMTKNQVKLTCLVKGFYPS DIAVEWESNGQPENNYKTTPPVLDSDGSFFLYSKLTVDKSRWQQGNVFSCSVMHEALHNHYTQKSLSLSPGK (SEQ ID NO: 1119)

Chain 3 - mAb B[NKG2D]_L1.1

DIQLTQSPSSLSASVGDRVTITC<u>RASGNIHNYLA</u>WYQQKPGKSPKVLVY<u>NAKTLAD</u>GVPSRFSGSGSGTDYTLTI SSLQPEDFATYYC<u>QHFWSTPWTF</u>GGGTKVEIK/RTVAAPSVFIFPPSDEQLKSGTASVVCLLNNFYPREAKVQWK VDNALQSGNSQESVTEQDSKDSTYSLSSTLTLSKADYEKHKVYACEVTHQGLSSPVTKSFNRGEC (SEQ ID NO: 1120)

Figure 122H

>XENP27627 human_IL15Ra(sushi)_(GGGGS)5-human_IL15(N4D/N65D;single-chain)-mAb B[NKG2D]_H2L2_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1121)

Chain 2 - mAb B[NKG2D]_H2_IgG1_pI(-)_Isosteric_A_C220S/PVA_/S267K/L368D/K370S-IgG1_PVA_/S267K/S364K/E357Q

EVQLVQSGAEVKKPGESLRISCKASGYTFTSYWMNWVRQMPGKGLEWMGRIDPYDSETHYNPSFQGHVTISVDKS
ISTAYLQWSSLKASDTAMYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1122)

Chain 3 - mAb B[NKG2D]_L2

DIQLTQSPDSLAVSLGERATINCKASGNIHNYLAWYQQKPGQSPKVLVYNAKTLADGVPSRFSGSGSGTDYTLTI
SSLQAEDVAVYYCQHFWSTTWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1123)

>XENP27628 human_IL15Ra(sushi)_(GGGGS)5-human_IL15(N4D/N65D;single-chain)-mAb B[NKG2D]_H3L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1124)

Chain 2 - mAb B[NKG2D]_H3_IgG1_pI(-)_Isosteric_A_C220S/PVA_/S267K/L368D/K370S-IgG1_PVA_/S267K/S364K/E357Q

EVQLVESGGGLVQPGGSLRLSCAASGYTFTSYWMNWVRQAPGKGLVWVSRIDPYDSETHYNQKVKGRFTISVDKA
KSTAYLQMNSLRAEDTAVYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1125)

Chain 3 - mAb B[NKG2D]_L1
DIQLTQSPSSLSASVGDRVTITCRASGNIHNYLAWYQQKPGKSPKVLVYNAKTLADGVPSRFSGSGSGTDYTLTI
SSLQPEDFATYYCQHFWSTTWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1126)

Figure 122I

>XENP27629 human_IL15Ra(sushi)_(GGGGS)5-human_IL15(N4D/N65D;single-chain)-mAb B[NKG2D]_H3_L1.1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1127)

Chain 2 - mAb B[NKG2D]_H3__IgG1_pI(-)_Isosteric_A_C220S/PVA_/S267K/L368D/K370S-IgG1_PVA_/S267K/S364K/E357Q

EVQLVESGGGLVQPGGSLRLSCAASGYTFTSYWMNWVRQAPGKGLVWVSRIDPYDSETHYNQKVKGRFTISVDKA
KSTAYLQMNSLRAEDTAVYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1128)

Chain 3 - mAb B[NKG2D]_L1.1

DIQLTQSPSSLSASVGDRVTITCRASGNIHNYLAWYQQKPGKSPKVLVYNAKTLADGVPSRFSGSGSGTDYTLTI
SSLQPEDFATYYCQHFWSTPWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1129)

>XENP27630 human_IL15Ra(sushi)_(GGGGS)5-human_IL15(N4D/N65D;single-chain)-mAb B[NKG2D]_H3L2_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1130)

Chain 2 - mAb B[NKG2D]_H3_IgG1_pI(-)_Isosteric_A_C220S/PVA_/S267K/L368D/K370S-IgG1_PVA_/S267K/S364K/E357Q

EVQLVESGGGLVQPGGSLRLSCAASGYTFTSYWMNWVRQAPGKGLVWVSRIDPYDSETHYNQKVKGRFTISVDKA
KSTAYLQMNSLRAEDTAVYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1131)

Chain 3 - mAb B[NKG2D]_L2

DIQLTQSPDSLAVSLGERATINCKASGNIHNYLAWYQQKPGQSPKVLVYNAKTLADGVPSRFSGSGSGTDYTLTI
SSLQAEDVAVYYCQHFWSTTWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1132)

Figure 122J

>XENP27631 human_IL15Ra(sushi)_(GGGGS)5-human_IL15(N4D/N65D;single-chain)-mAb
C[NKG2D]_H1L1_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVSHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1133)

**Chain 2 - mAb C[NKG2D]_H1_IgG1_pI(-)_Isosteric_A_C220S/PVA_/S267K/L368D/K370S-
IgG1_PVA_/S267K/S364K/E357Q**

EVQLVESGGGLVQPGGSLRLSCAVSGFSLT<u>IYGVH</u>WVRQAPGKGLEWVS<u>VIWSGGSTDYNAKVKG</u>RFTISKDNSK
RTVYLQMNSLRAEDTAVYYCSR<u>KSHDGYYGVMDY</u>WGQGTTVTSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 1134)

Chain 3 - mAb C[NKG2D]_L1

DIQLTQSPDFQSVTPKEKVTITC<u>RASQSIGTSIH</u>WYQQKPDQSPKLLIK<u>YASESIS</u>GIPSRFSGSGSGTDFTLTI
NSLEAEDAATYYC<u>QQSNTWPLT</u>FGAGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1135)

>XENP27632 human_IL15Ra(sushi)_(GGGGS)5-human_IL15(N4D/N65D;single-chain)-mAb
C[NKG2D]_H1L2_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVSHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1136)

**Chain 2 - mAb C[NKG2D]_H1_IgG1_pI(-)_Isosteric_A_C220S/PVA_/S267K/L368D/K370S-
IgG1_PVA_/S267K/S364K/E357Q**

EVQLVESGGGLVQPGGSLRLSCAVSGFSLT<u>IYGVH</u>WVRQAPGKGLEWVS<u>VIWSGGSTDYNAKVKG</u>RFTISKDNSK
RTVYLQMNSLRAEDTAVYYCSR<u>KSHDGYYGVMDY</u>WGQGTTVTSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVSHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 1137)

Chain 3 - mAb C[NKG2D]_L2

DIQLTQSPSSLSASVGDRVTITC<u>RASQSIGTSIH</u>WYQQKPGKSPKLLIK<u>YASESIS</u>GIPSRFSGSGSGTDFTLTI
SSLQPEDFATYYC<u>QQSNTWPLT</u>FGAGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1138)

Figure 122K

>XENP27633 human_IL15Ra(sushi)_(GGGGS)5-human_IL15(N4D/N65D;single-chain)-mAb
C[NKG2D]_H2L1_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S**
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1139)

**Chain 2 - mAb C[NKG2D]_H2_IgG1_pI(-)_Isosteric_A_C220S/PVA_/S267K/L368D/K370S-
IgG1_PVA_/S267K/S364K/E357Q**
QVQLVQSGAEVKKPGASVKVSCKVSGFSLT<u>IYGVH</u>WVRQAPGQGLEWMG<u>VIWSGGSTDYNAKFQG</u>RVTMTKDNSK
RTVYMELSSLRSEDTAVYYCSR<u>KSHDGYYGVMDY</u>WGQGTTVTSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 1140)

Chain 3 - mAb C[NKG2D]_L1
DIQLTQSPDFQSVTPKEKVTITC<u>RASQSIGTSIH</u>WYQQKPDQSPKLLIK<u>YASESIS</u>GIPSRFSGSGSGTDFTLTI
NSLEAEDAATYYC<u>QQSNTWPLT</u>FGAGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1141)

>XENP27634 human_IL15Ra(sushi)_(GGGGS)5-human_IL15(N4D/N65D;single-chain)-mAb
C[NKG2D]_H2L2_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S**
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1142)

**Chain 2 - mAb C[NKG2D]_H2_IgG1_pI(-)_Isosteric_A_C220S/PVA_/S267K/L368D/K370S-
IgG1_PVA_/S267K/S364K/E357Q**
QVQLVQSGAEVKKPGASVKVSCKVSGFSLT<u>IYGVH</u>WVRQAPGQGLEWMG<u>VIWSGGSTDYNAKFQG</u>RVTMTKDNSK
RTVYMELSSLRSEDTAVYYCSR<u>KSHDGYYGVMDY</u>WGQGTTVTSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 1143)

Chain 3 - mAb C[NKG2D]_L2
DIQLTQSPSSLSASVGDRVTITC<u>RASQSIGTSIH</u>WYQQKPGKSPKLLIK<u>YASESIS</u>GIPSRFSGSGSGTDFTLTI
SSLQPEDFATYYC<u>QQSNTWPLT</u>FGAGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1144)

Figure 122L

>XENP27635 human_IL15Ra(sushi)_(GGGGS)5-human_IL15(N4D/N65D;single-chain)-mAb
A[NKG2D]_H1L1_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1145)

**Chain 2 - mAb A[NKG2D]_H1_IgG1_pI(-)_Isosteric_A_C220S/PVA_/S267K/L368D/K370S-
IgG1_PVA_/S267K/S364K/E357Q**
QVQLVQSGAEVKKPGASVKVSCKVSGFSLTSYGVHWIRQAPGQGLEWMGVIWAGGSTNYNSKFQGRVTMTKDNSK
STVYMELSSLRSEDTAVYYCARGGYEGAAWFGYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 1146)
Chain 3 - mAb A[NKG2D]_L1
DIQLTQSPSSLSASVGDRVTITCRASSSVSYMHWYQQKPGKSPKPLIYATSNLASGVPARFSGSGSGTDYTLTIS
SLQPEDFATYYCQQWNSNPLTFGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID
NO: 1147)

>XENP27636 human_IL15Ra(sushi)_(GGGGS)5-human_IL15(N4D/N65D;single-chain)-mAb
A[NKG2D]_H1L2_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1148)

**Chain 2 - mAb A[NKG2D]_H1_IgG1_pI(-)_Isosteric_A_C220S/PVA_/S267K/L368D/K370S-
IgG1_PVA_/S267K/S364K/E357Q**
QVQLVQSGAEVKKPGASVKVSCKVSGFSLTSYGVHWIRQAPGQGLEWMGVIWAGGSTNYNSKFQGRVTMTKDNSK
STVYMELSSLRSEDTAVYYCARGGYEGAAWFGYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 1149)
Chain 3 - mAb A[NKG2D]_L2
DIQLTQSPATLSLSPGERATLSCRASSSVSYMHWYQQKPGQSPRPLIYATSNLASGVPARFSGSGSGTDYTLTIS
SLEPEDFAVYYCQQWNSNPLTFGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID
NO: 1150)

Figure 122M

>XENP27637 human_IL15Ra(sushi)_(GGGGS)5-human_IL15(N4D/N65D;single-chain)-mAb A[NKG2D]_H2L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S

ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO: 1151)

Chain 2 - mAb A[NKG2D]_H2_IgG1_pI(-)_Isosteric_A_C220S/PVA_/S267K/L368D/K370S-IgG1_PVA_/S267K/S364K/E357Q

QVQLQESGPGLVKPSETLSLTCTVSGFSLT<u>SYGVH</u>WIRQPPGKGLEWIG<u>VIWAGGSTNYNPSLKS</u>RVTISKDNSK
SQVSLKLSSVTAADTAVYYCAR<u>GGYEGAAWFGY</u>WGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 1152)

Chain 3 - mAb A[NKG2D]_L1
DIQLTQSPSSLSASVGDRVTITC<u>RASSSVSYMH</u>WYQQKPGKSPKPLIY<u>ATSNLAS</u>GVPARFSGSGSGTDYTLTIS
SLQPEDFATYYC<u>QQWNSNPLT</u>FGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 1153)

>XENP27638 human_IL15Ra(sushi)_(GGGGS)5-human_IL15(N4D/N65D;single-chain)-mAb A[NKG2D]_H2L2_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO: 1154)

Chain 2 - mAb A[NKG2D]_H2_IgG1_pI(-)_Isosteric_A_C220S/PVA_/S267K/L368D/K370S-IgG1_PVA_/S267K/S364K/E357Q
QVQLQESGPGLVKPSETLSLTCTVSGFSLT<u>SYGVH</u>WIRQPPGKGLEWIG<u>VIWAGGSTNYNPSLKS</u>RVTISKDNSK
SQVSLKLSSVTAADTAVYYCAR<u>GGYEGAAWFGY</u>WGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 1155)

Chain 3 - mAb A[NKG2D]_L2
DIQLTQSPATLSLSPGERATLSC<u>RASSSVSYMH</u>WYQQKPGQSPRPLIY<u>ATSNLAS</u>GVPARFSGSGSGTDYTLTIS
SLEPEDFAVYYC<u>QQWNSNPLT</u>FGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 1156)

Figure 122N

>XENP30592 human_IL15Ra(sushi)_(GGGGS)5-human_IL15(N4D/N65D;single-chain)-
1D7B4[NKG2D]_H1L1_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S ITCPPPMSVEHADIWVKSYSLYSRERYICNSGFKRKAGTSSLTECVLNKATNVAHWTTPSLKCIR/GGGGSGGGGSGGG
GSGGGGSGGGGS/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK (SEQ ID NO: 1157)

Chain 2 - 1D7B4[NKG2D]_H1_IgG1_PVA_/S267K/S364K/E357Q

EVQLLESGGGLVQPGGSLRLSCAASGFTFSSYAMSWVRQAPGKGLEWVSSISASGGSTYYADSVKGRFTISRDNSKNTL
YLQMNSLRAEDTAVYYCAKGIFSIYFFYFDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREQMTKNQVKLTCLVKGFYPSDIAVEWESNGQPENNY
KTTPPVLDSDGSFFLYSKLTVDKSRWQQGNVFSCSVMHEALHNHYTQKSLSLSPGK (SEQ ID NO: 1158)

Chain 3 - 1D7B4[NKG2D]_L1

DIQMTQSPSSLSASVGDRVTITCRASQSISSYLNWYQQKPGKAPKLLIYAASSLQSGVPSRFSGSGSGTDFTLTISSLQ
PEDFATYYCQQSYSTPYTFGQGTKLEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC (SEQ ID NO: 1159)

>XENP31077 human_IL15Ra(sushi)_(GGGGS)5-human_IL15(N4D/N65D;single-chain)-mAb
A[NKG2D]_H1L1_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S/M428L/N434S ITCPPPMSVEHADIWVKSYSLYSRERYICNSGFKRKAGTSSLTECVLNKATNVAHWTTPSLKCIR/GGGGSGGGGSGGG
GSGGGGSGGGGS/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVLHEALHSHYTQKSLSLSPGK (SEQ ID NO: 1160)

Chain 2 - mAb A[NKG2D]_H1_IgG1_PVA_/S267K/S364K/E357Q/M428L/N434S

QVQLVQSGAEVKKPGASVKVSCKVSGFSLTSYGVHWIRQAPGQGLEWMGVIWAGGSTNYNSKFQGRVTMTKDNSKSTVY
MELSSLRSEDTAVYYCARGGYEGAAWFGYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVLHEALHSHYTQKSLSLSPGK (SEQ ID NO: 1161)

Chain 3 - mAb A[NKG2D]_L1

DIQLTQSPSSLSASVGDRVTITCRASSSVSYMHWYQQKPGKSPKPLIYATSNLASGVPARFSGSGSGTDYTLTISSLQP
EDFATYYCQQWNSNPLTFGAGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC (SEQ ID NO: 1162)

Figure 123

| Description | $K_D$ (M) | $k_a$ (1/Ms) | $k_d$ (1/s) |
|---|---|---|---|
| XENP 27195 – NKG2D(KYK-2.0)-targeted IL-15(N4D/N65D)/Rα-Fc | 3.65E-09 | 7.45E+05 | 2.72E-03 |
| NKG2D(Clone 001)-targeted IL-15(N4D/N65D)/Rα-XtendFc | 3.30E-08 | 1.93E+05 | 6.37E-03 |
| XENP27197 – NKG2D(1D7B4)-targeted IL-15(N4D/N65D)/Rα-XtendFc | 8.66E-09 | 3.75E+05 | 3.25E-03 |
| NKG2D(Clone 002)-targeted IL-15(N4D/N65D)/Rα-XtendFc | 8.66E-08* | 1.35E+05 | 1.17E-02 |
| NKG2D(Clone 003)-targeted IL-15(N4D/N65D)/Rα-XtendFc | 1.70E-07* | 1.93E+05 | 3.28E-02 |
| NKG2D(Clone 004)-targeted IL-15(N4D/N65D)/Rα-XtendFc | 5.72E-08* | 7.30E+05 | 4.18E-02 |
| XENP27145 – NKG2D(MS)-targeted IL-15(N4D/N65D)/Rα-Fc | 2.45E-09 | 5.02E+05 | 1.23E-03 |

Figure 125A

>XENP27591 11B2D10[NKG2D]_H0L0_IgG1_PVA_/S267K

Heavy Chain - 11B2D10[NKG2D]_H0_IgG1_PVA_/S267K
QVQLQQSGPELVRPGASVKLSCKASGYTFTSYWMNWVQQRPEQGLEWIGRIDPYDSETHYNQKFKDKAILTVDKS
ASTAYMQLSSLTSEDSAVYYCAKMGDYSFDYWGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK (SE
Q ID NO: 1163)

Light Chain - 11B2D10[NKG2D]_L0
DIQLTQSPASLSASVGETVTITCRASGNIHNYLAWYQQKQGKSPQVLVYNAKTLADGVPSRFSGSGSGTQYSLKI
NSLQPEDFGSYYCQHFWSTTWTFGGGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1164)

>XENP27592 6E5A7[NKG2D]_H0L0_IgG1_PVA_/S267K

Heavy Chain - 6E5A7[NKG2D]_H0_IgG1_PVA_/S267K
QVQLQQSGPGLVQPSQSLSITCTVSGFSLTIYGVHWVRQSPGKGLEWLGVIWSGGSTDYNAAFISRLSISKDNSK
RQVFFKMSSLQANDTAIYYCSRKSHDGYYGVMDYWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 1165)

Light Chain - 6E5A7[NKG2D]_L0
DIQLTQSPAILSVSPGERVSFSCRASQSIGTSIHWYQQRTNGSPRLLIKYASESISGIPSRFSGSGSGTDFTLSI
NGVESEDIADYYCQQSNTWPLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1166)

>XENP27593 6H7E7[NKG2D]_H0L0_IgG1_PVA_/S267K

Heavy Chain - 6H7E7[NKG2D]_H0_IgG1_PVA_/S267K
QVQLQESGPGLVAPSQSLSITCTVSGFSLTSYGVHWIRQPPGKGLEWLGVIWAGGSTNYNSALMSRLSISKDNSK
SQVFLKMNSLQIDDTAMYYCARGGYEGAAWFGYWGQGTTVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 1167)

Light Chain - 6H7E7[NKG2D]_L0
DIQLTQSPAILSASPGEKVTMTCRASSSVSYMHWYQQKPGSSPKPWIYATSNLASGVPARFSGSGSGTSYSLTIS
RVEAEDAATYYCQQWNSNPLTFGAGTKLEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID
NO: 1168)

Figure 125B

>XENP27594 mAb E[NKG2D]_H1L1_IgG1_PVA_/S267K
Heavy Chain - mAb E[NKG2D]_H1_IgG1_PVA_/S267K
EVQLVESGGGLVKPGGSLRLSCAASGFTFSSYSMNWVRQAPGKGLEWVSSITSSSSYIYYADSVKGRFTISRDNA
KNSLYLQMNSLRAEDTAVYYCARDRRYFDWFPLDYRGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREEMTKNQVSLTCLVKG
FYPSDIAVEWESNGQPENNYKTTPPVLDSDGSFFLYSKLTVDKSRWQQGNVFSCSVMHEALHNHYTQKSLSLSPG
K (SEQ ID NO: 1169)

Light Chain - mAb E[NKG2D]_L1
DIQMTQSPSSLSASVGDRVTITCRASQGISSWLAWYQQKPEKAPKSLIYAASSLQSGVPSRFSGSGSGTDFTLTI
SSLQPEDFATYYCQQYNGYPYTFGQGTKLEIKR/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC (SEQ ID
NO: 1170)

>XENP27595 16F31[NKG2D]_H1L1_IgG1_PVA_/S267K
Heavy Chain - 16F31[NKG2D]_H1_IgG1_PVA_/S267K
EVQLVESGGGVVRPGGSLRLSCAASGFTFDDYGMTWVRQAPGKGLEWVSGINWNGGSTGYADSVKGRFTISRDNA
KNSLYLQMNSLRAEDTALYYCARERELYYYYGLDVWGQGTTVTVSS/ASTKGPSVFPLAPSSKSTSGGTAALGC
LVKDYFPEPVTVSWNSGALTSGVHTFPAVLQSSGLYSLSSVVTVPSSSLGTQTYICNVNHKPSNTKVDKKVEPKS
CDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHYTQKSLSLSP
GK (SEQ ID NO: 1171)

Light Chain - 16F31[NKG2D]_L1
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPFTFGPGTKVDIKR/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC (SEQ ID
NO: 1172)

>XENP27596 mAb D[NKG2D]_H1L1_IgG1_PVA_/S267K

Heavy Chain - mAb D[NKG2D]_H1_IgG1_PVA_/S267K
QVQLVQSGAEVKKPGASVKVSCKASGYTFTNYWMHWVRQAPGQGLEWMGEIDPSDIYTNYAQKFQGRVTMTRDTS
TSTVYMELSSLRSEDTAVYYCARGIYDGYYVYGMDYWGQGTTVTVSS/ASTKGPSVFPLAPSSKSTSGGTAALGC
LVKDYFPEPVTVSWNSGALTSGVHTFPAVLQSSGLYSLSSVVTVPSSSLGTQTYICNVNHKPSNTKVDKKVEPKS
CDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHYTQKSLSLSP
GK (SEQ ID NO: 1173)

Light Chain - mAb D[NKG2D]_L1
YIQMTQSPSSLSASVGDRVTITCRSSQDISNYLNWYQQKPGKAPKLLIYYTSRLHSGVPSRFSGSGSGTDFTFTI
SSLQPEDIATYYCQQGKTLPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1174)

Figure 125C

>XENP27597 KYK-1.0[NKG2D]_H1L1_IgG1_PVA_/S267K
Heavy Chain - KYK-1.0[NKG2D]_H1_IgG1_PVA_/S267K
EVQLVESGGGVVQPGGSLRLSCAASGFTFSSYGMHWVRQAPGKGLEWVAFIRYDGSNKYYADSVKGRFTISRDNS
KNTKYLQMNSLRAEDTAVYYCAKDRFGYYLDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREEMTKNQVSLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 1175)

Light Chain - KYK-1.0[NKG2D]_L1
QPVLTQPSSVSVAPGETARIPCGGDDIETKSVHWYQQKPGQAPVLVIYDDDDRPSGIPERFFGSNSGNTATLSIS
RVEAGDEADYYCQVWDDNNDEWVFGGGTQLTVLGQPKAAPSVTLFPPSSEELQANKATLVCLISDFYPGAVTVAW
KADSSPVKAGVETTTPSKQSNNKYAASSYLSLTPEQWKSHRSYSCQVTHEGSTVEKTVAPTECS(SEQ ID NO:
1176)

Figure 126A

>XENP27598 mAb B[NKG2D]_H1L1_IgG1_PVA_/S267K

Heavy Chain - mAb B[NKG2D]_H1_IgG1_PVA_/S267K
QVQLVQSGAEVKKPGASVKVSCKASGYTFTSYWMNWVRQAPGQGLEWMGRIDPYDSETHYNQKFQGRVTMTVDKS
TSTAYMELSSLRSEDTAVYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1177)

Light Chain - mAb B[NKG2D]_L1
DIQLTQSPSSLSASVGDRVTITCRASGNIHNYLAWYQQKPGKSPKVLVYNAKTLADGVPSRFSGSGSGTDYTLTI
SSLQPEDFATYYCQHFWSTTWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1178)

>XENP27599 mAb B[NKG2D]_H1_L1.1_IgG1_PVA_/S267K

Heavy Chain - mAb B[NKG2D]_H1__IgG1_PVA_/S267K
QVQLVQSGAEVKKPGASVKVSCKASGYTFTSYWMNWVRQAPGQGLEWMGRIDPYDSETHYNQKFQGRVTMTVDKS
TSTAYMELSSLRSEDTAVYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1179)

Light Chain - mAb B[NKG2D]_L1.1
DIQLTQSPSSLSASVGDRVTITCRASGNIHNYLAWYQQKPGKSPKVLVYNAKTLADGVPSRFSGSGSGTDYTLTI
SSLQPEDFATYYCQHFWSTPWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1180)

>XENP27600 mAb B[NKG2D]_H1L2_IgG1_PVA_/S267K

Heavy Chain - mAb B[NKG2D]_H1_IgG1_PVA_/S267K
QVQLVQSGAEVKKPGASVKVSCKASGYTFTSYWMNWVRQAPGQGLEWMGRIDPYDSETHYNQKFQGRVTMTVDKS
TSTAYMELSSLRSEDTAVYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1181)

Light Chain - mAb B[NKG2D]_L2
DIQLTQSPDSLAVSLGERATINCKASGNIHNYLAWYQQKPGQSPKVLVYNAKTLADGVPSRFSGSGSGTDYTLTI
SSLQAEDVAVYYCQHFWSTTWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC  (SEQ ID
NO: 1182)

Figure 126B

>XENP27601 mAb B[NKG2D]_H2L1_IgG1_PVA_/S267K

Heavy Chain - mAb B[NKG2D]_H2_IgG1_PVA_/S267K
EVQLVQSGAEVKKPGESLRISCKASGYTFTSYWMNWVRQMPGKGLEWMGRIDPYDSETHYNPSFQGHVTISVDKS
ISTAYLQWSSLKASDTAMYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1183)

Light Chain - mAb B[NKG2D]_L1
DIQLTQSPSSLSASVGDRVTITCRASGNIHNYLAWYQQKPGKSPKVLVYNAKTLADGVPSRFSGSGSGTDYTLTI
SSLQPEDFATYYCQHFWSTTWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1184)

>XENP27602 mAb B[NKG2D]_H2_L1.1_IgG1_PVA_/S267K

Heavy Chain - mAb B[NKG2D]_H2__IgG1_PVA_/S267K
EVQLVQSGAEVKKPGESLRISCKASGYTFTSYWMNWVRQMPGKGLEWMGRIDPYDSETHYNPSFQGHVTISVDKS
ISTAYLQWSSLKASDTAMYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1185)

Light Chain - mAb B[NKG2D]_L1.1
DIQLTQSPSSLSASVGDRVTITCRASGNIHNYLAWYQQKPGKSPKVLVYNAKTLADGVPSRFSGSGSGTDYTLTI
SSLQPEDFATYYCQHFWSTPWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1186)

>XENP27603 mAb B[NKG2D]_H2L2_IgG1_PVA_/S267K

Heavy Chain - mAb B[NKG2D]_H2_IgG1_PVA_/S267K
EVQLVQSGAEVKKPGESLRISCKASGYTFTSYWMNWVRQMPGKGLEWMGRIDPYDSETHYNPSFQGHVTISVDKS
ISTAYLQWSSLKASDTAMYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1187)

Light Chain - mAb B[NKG2D]_L2
DIQLTQSPDSLAVSLGERATINCKASGNIHNYLAWYQQKPGQSPKVLVYNAKTLADGVPSRFSGSGSGTDYTLTI
SSLQAEDVAVYYCQHFWSTTWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1188)

Figure 126C

<u>>XENP27604 mAb B[NKG2D]_H3L1_IgG1_PVA_/S267K</u>

Heavy Chain - mAb B[NKG2D]_H3_IgG1_PVA_/S267K
EVQLVESGGGLVQPGGSLRLSCAASGYTFTS<u>YWMN</u>WVRQAPGKGLVWVS<u>RIDPYDSETHYNQKVKG</u>RFTISVDKA
KSTAYLQMNSLRAEDTAVYYCAK<u>MGDYSFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1189)

Light Chain - mAb B[NKG2D]_L1
DIQLTQSPSSLSASVGDRVTITC<u>RASGNIHNYLA</u>WYQQKPGKSPKVLVY<u>NAKTLAD</u>GVPSRFSGSGSGTDYTLTI
SSLQPEDFATYYC<u>QHFWSTTWT</u>FGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1190)

<u>>XENP27605 mAb B[NKG2D]_H3_L1.1_IgG1_PVA_/S267K</u>

Heavy Chain - mAb B[NKG2D]_H3__IgG1_PVA_/S267K
EVQLVESGGGLVQPGGSLRLSCAASGYTFTS<u>YWMN</u>WVRQAPGKGLVWVS<u>RIDPYDSETHYNQKVKG</u>RFTISVDKA
KSTAYLQMNSLRAEDTAVYYCAK<u>MGDYSFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1191)

Light Chain - mAb B[NKG2D]_L1.1
DIQLTQSPSSLSASVGDRVTITC<u>RASGNIHNYLA</u>WYQQKPGKSPKVLVY<u>NAKTLAD</u>GVPSRFSGSGSGTDYTLTI
SSLQPEDFATYYC<u>QHFWSTPWT</u>FGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1192)

<u>>XENP27606 mAb B[NKG2D]_H3L2_IgG1_PVA_/S267K</u>

Heavy Chain - mAb B[NKG2D]_H3_IgG1_PVA_/S267K
EVQLVESGGGLVQPGGSLRLSCAASGYTFTS<u>YWMN</u>WVRQAPGKGLVWVS<u>RIDPYDSETHYNQKVKG</u>RFTISVDKA
KSTAYLQMNSLRAEDTAVYYCAK<u>MGDYSFDY</u>WGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK
(SEQ ID NO: 1193)

Light Chain - mAb B[NKG2D]_L2
DIQLTQSPDSLAVSLGERATINC<u>KASGNIHNYLA</u>WYQQKPGQSPKVLVY<u>NAKTLAD</u>GVPSRFSGSGSGTDYTLTI
SSLQAEDVAVYYC<u>QHFWSTTWT</u>FGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1194)

Figure 126D

>XENP27607 mAb C[NKG2D]_H1L1_IgG1_PVA_/S267K

Heavy Chain - mAb C[NKG2D]_H1_IgG1_PVA_/S267K
EVQLVESGGGLVQPGGSLRLSCAVSGFSLTIYGVHWVRQAPGKGLEWVSVIWSGGSTDYNAKVKGRFTISKDNSK
RTVYLQMNSLRAEDTAVYYCSRKSHDGYYGVMDYWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 1195)

Light Chain - mAb C[NKG2D]_L1
DIQLTQSPDFQSVTPKEKVTITCRASQSIGTSIHWYQQKPDQSPKLLIKYASESISGIPSRFSGSGSGTDFTLTI
NSLEAEDAATYYCQQSNTWPLTFGAGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1196)

>XENP27608 mAb C[NKG2D]_H1L2_IgG1_PVA_/S267K

Heavy Chain - mAb C[NKG2D]_H1_IgG1_PVA_/S267K
EVQLVESGGGLVQPGGSLRLSCAVSGFSLTIYGVHWVRQAPGKGLEWVSVIWSGGSTDYNAKVKGRFTISKDNSK
RTVYLQMNSLRAEDTAVYYCSRKSHDGYYGVMDYWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 1197)

Light Chain - mAb C[NKG2D]_L2
DIQLTQSPSSLSASVGDRVTITCRASQSIGTSIHWYQQKPGKSPKLLIKYASESISGIPSRFSGSGSGTDFTLTI
SSLQPEDFATYYCQQSNTWPLTFGAGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1198)

>XENP27609 mAb C[NKG2D]_H2L1_IgG1_PVA_/S267K

Heavy Chain - mAb C[NKG2D]_H2_IgG1_PVA_/S267K
QVQLVQSGAEVKKPGASVKVSCKVSGFSLTIYGVHWVRQAPGQGLEWMGVIWSGGSTDYNAKFQGRVTMTKDNSK
RTVYMELSSLRSEDTAVYYCSRKSHDGYYGVMDYWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 1199)

Light Chain - mAb C[NKG2D]_L1
DIQLTQSPDFQSVTPKEKVTITCRASQSIGTSIHWYQQKPDQSPKLLIKYASESISGIPSRFSGSGSGTDFTLTI
NSLEAEDAATYYCQQSNTWPLTFGAGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1200)

Figure 126E

>XENP27610 mAb C[NKG2D]_H2L2_IgG1_PVA_/S267K

Heavy Chain - mAb C[NKG2D]_H2_IgG1_PVA_/S267K
QVQLVQSGAEVKKPGASVKVSCKVSGFSLTIYGVHWVRQAPGQGLEWMGVIWSGGSTDYNAKFQGRVTMTKDNSK
RTVYMELSSLRSEDTAVYYCSRKSHDGYYGVMDYWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 1201)

Light Chain - mAb C[NKG2D]_L2
DIQLTQSPSSLSASVGDRVTITCRASQSIGTSIHWYQQKPGKSPKLLIKYASESISGIPSRFSGSGSGTDFTLTI
SSLQPEDFATYYCQQSNTWPLTFGAGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 1202)

>XENP27611 mAb A[NKG2D]_H1L1_IgG1_PVA_/S267K

Heavy Chain - mAb A[NKG2D]_H1_IgG1_PVA_/S267K
QVQLVQSGAEVKKPGASVKVSCKVSGFSLTSYGVHWIRQAPGQGLEWMGVIWAGGSTNYNSKFQGRVTMTKDNSK
STVYMELSSLRSEDTAVYYCARGGYEGAAWFGYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 1203)

Light Chain - mAb A[NKG2D]_L1
DIQLTQSPSSLSASVGDRVTITCRASSSVSYMHWYQQKPGKSPKPLIYATSNLASGVPARFSGSGSGTDYTLTIS
SLQPEDFATYYCQQWNSNPLTFGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID
NO: 1204)

>XENP27612 mAb A[NKG2D]_H1L2_IgG1_PVA_/S267K

Heavy Chain - mAb A[NKG2D]_H1_IgG1_PVA_/S267K
QVQLVQSGAEVKKPGASVKVSCKVSGFSLTSYGVHWIRQAPGQGLEWMGVIWAGGSTNYNSKFQGRVTMTKDNSK
STVYMELSSLRSEDTAVYYCARGGYEGAAWFGYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 1205)

Light Chain - mAb A[NKG2D]_L2
DIQLTQSPATLSLSPGERATLSCRASSSVSYMHWYQQKPGQSPRPLIYATSNLASGVPARFSGSGSGTDYTLTIS
SLEPEDFAVYYCQQWNSNPLTFGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID
NO: 1206)

Figure 126F

>XENP27613 mAb A[NKG2D]_H2L1_IgG1_PVA_/S267K

Heavy Chain - mAb A[NKG2D]_H2_IgG1_PVA_/S267K
QVQLQESGPGLVKPSETLSLTCTVSGFSLTSYGVHWIRQPPGKGLEWIGVIWAGGSTNYNPSLKSRVTISKDNSK
SQVSLKLSSVTAADTAVYYCARGGYEGAAWFGYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 1207)

Light Chain - mAb A[NKG2D]_L1
DIQLTQSPSSLSASVGDRVTITCRASSSVSYMHWYQQKPGKSPKPLIYATSNLASGVPARFSGSGSGTDYTLTIS
SLQPEDFATYYCQQWNSNPLTFGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID
NO: 1208)

>XENP27614 mAb A[NKG2D]_H2L2_IgG1_PVA_/S267K

Heavy Chain - mAb A[NKG2D]_H2_IgG1_PVA_/S267K
QVQLQESGPGLVKPSETLSLTCTVSGFSLTSYGVHWIRQPPGKGLEWIGVIWAGGSTNYNPSLKSRVTISKDNSK
SQVSLKLSSVTAADTAVYYCARGGYEGAAWFGYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 1209)

Light Chain - mAb A[NKG2D]_L2
DIQLTQSPATLSLSPGERATLSCRASSSVSYMHWYQQKPGQSPRPLIYATSNLASGVPARFSGSGSGTDYTLTIS
SLEPEDFAVYYCQQWNSNPLTFGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC SEQ ID NO:
1210)

Figure 127

| XENP | Description | K$_D$ (M) | k$_a$ (1/Ms) | k$_d$ (1/s) |
|---|---|---|---|---|
| 27593 | 6H7E7[NKG2D]_H0L0 | 1.00E-12 | 2.31E+05 | 1.00E-07 |
| 27591 | 11B2D10[NKG2D]_H0L0 | 5.47E-10 | 1.45E+06 | 7.92E-04 |
| 27592 | 6E5A7[NKG2D]_H0L0 | 1.00E-12 | 4.89E+05 | 1.00E-07 |
| 27597 | KYK-1.0[NKG2D]_H1L1 | 6.13E-10 | 1.85E+06 | 1.13E-03 |
| 27596 | mAb D[NKG2D]_H1L1 | 1.00E-12 | 6.98E+05 | 1.00E-07 |
| 27595 | 16F31[NKG2D]_H1L1 | 3.02E-09 | 1.55E+05 | 4.68E-04 |
| 27594 | mAb E[NKG2D]_H1L1 | 3.43E-10 | 1.13E+06 | 3.87E-04 |
| 27614 | mAb A[NKG2D]_H2L2 | 1.00E-12 | 2.00E+05 | 1.00E-07 |
| 27612 | mAb A[NKG2D]_H1L2 | 1.00E-12 | 2.24E+05 | 1.00E-07 |
| 27611 | mAb A[NKG2D]_H1L1 | 1.00E-12 | 2.28E+05 | 1.00E-07 |
| 27613 | mAb A[NKG2D]_H2L1 | 1.00E-12 | 2.54E+05 | 1.00E-07 |
| 27599 | mAb B[NKG2D]_H1_L1.1 | 3.50E-09 | 4.82E+05 | 1.69E-03 |
| 27602 | mAb B[NKG2D]_H2_L1.1 | 1.95E-09 | 7.40E+05 | 1.44E-03 |
| 27605 | mAb B[NKG2D]_H3_L1.1 | 3.28E-09 | 2.88E+06 | 9.43E-03 |
| 27606 | mAb B[NKG2D]_H3L2 | 1.15E-09 | 1.77E+06 | 2.04E-03 |
| 27604 | mAb B[NKG2D]_H3L1 | 1.01E-09 | 1.91E+06 | 1.94E-03 |
| 27603 | mAb B[NKG2D]_H2L2 | 7.03E-10 | 1.73E+06 | 1.21E-03 |
| 27601 | mAb B[NKG2D]_H2L1 | 8.94E-10 | 1.23E+06 | 1.10E-03 |
| 27600 | mAb B[NKG2D]_H1L2 | 5.95E-10 | 1.12E+06 | 6.66E-04 |
| 27598 | mAb B[NKG2D]_H1L1 | 6.79E-10 | 1.10E+06 | 7.46E-04 |
| 27607 | mAb C[NKG2D]_H1L1 | 5.06E-10 | 7.06E+05 | 3.57E-04 |
| 27608 | mAb C[NKG2D]_H1L2 | 3.71E-10 | 8.32E+05 | 3.08E-04 |
| 27609 | mAb C[NKG2D]_H2L1 | 1.67E-10 | 5.18E+05 | 8.64E-05 |
| 27610 | mAb C[NKG2D]_H2L2 | 1.99E-10 | 7.27E+05 | 1.45E-04 |

Figure 128

>XENP21993 human_IL15Ra(sushi)_(GGGGS)5-human_IL15(single-Chain)-empty-Fc_Fc(216)_IgG1_pI(-
)_Isosteric_A_C220S/PVA_/S267K/L368D/K370S-Fc(216)_IgG1_C220S/PVA_/S267K/S364K/E357Q XENP21993 Chain 1 - human_IL15Ra(sushi)_(GGGGS)5-human_IL15(single-Chain)_Fc(216)_IgG1_pI(-
)_Isosteric_A_C220S/PVA_/S267K/L368D/K370S ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO:
1211)

XENP21993 Chain 2 - empty-Fc(216)_IgG1_C220S/PVA_/S267K/S364K/E357Q

EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK (SEQ ID NO: 1212)

Figure 129

>XENP22853 human_IL15_(GGGGS)1-human_IL15Ra(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S XENP22853 Chain 1 - human_IL15_(GGGGS)1-Fc(216)_IgG1_pI(-
)_Isosteric_A_C220S/PVA_/S267K/L368D/K370S/M428L/N434S NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK (SEQ ID NO: 1213)

XENP22853 Chain 2 - human_IL15Ra(Sushi)_(GGGGS)1-
Fc(216)_IgG1_C220S/PVA_/S267K/S364K/E357Q/M428L/N434S ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK (SEQ ID NO: 1214)

Figure 130

>XENP24050 human_IL15Ra(sushi)_(GGGGS)5-human_IL15_N4D/N65D_(single-Chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q XENP24050 Chain 1 - human_IL15Ra(sushi)_(GGGGS)5-human_IL15_N4D/N65D_(single-Chain)-
Fc(216)_IgG1_pI(-)_Isosteric_A_C220S/PVA_/S267K/L368D/K370S ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK (SEQ ID NO: 1215)

XENP24050 Chain 2 - empty-Fc(216)_IgG1_C220S/PVA_/S267K/S364K/E357Q

EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK (SEQ ID NO: 1216)

Figure 131

>XENP24113 human_IL15_N4D/N65D_(GGGGS)1-human_IL15Ra(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S XENP24113 Chain 1 - human_IL15_N4D/N65D_(GGGGS)1-Fc(216)_IgG1_pI(-
)_Isosteric_A_C220S/PVA_/S267K/L368D/K370S/M428L/N434S NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK (SEQ ID NO: 1217)

XENP24113 Chain 2 - human_IL15Ra(Sushi)_(GGGGS)1-
Fc(216)_IgG1_C220S/PVA_/S267K/S364K/E357Q/M428L/N434S ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK (SEQ ID NO: 1218)

Figure 132

>XENP24294 human_IL15Ra(sushi)_(GGGGS)5-human_IL15_N4D/N65D_(single-Chain)-empty-
Fc_Fc(216)_IgG1_pI(-)_Isosteric_A_C220S/PVA_/S267K/L368D/K370S/M428L/N434S-
Fc(216)_IgG1_C220S/PVA_/S267K/S364K/E357Q/M428L/N434S XENP24294 Chain 1 - human_IL15Ra(sushi)_(GGGGS)5-human_IL15_N4D/N65D_(single-Chain)-
Fc(216)_IgG1_pI(-)_Isosteric_A_C220S/PVA_/S267K/L368D/K370S/M428L/N434S
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK (SEQ ID NO:
1219)

XENP24294 Chain 2 - empty-Fc(216)_IgG1_C220S/PVA_/S267K/S364K/E357Q/M428L/N434S
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVLHEALHSHYTQKSL
SLSPGK (SEQ ID NO: 1220)

Figure 133

>XENP24306 human_IL15_D30N/E64Q/N65D_(GGGGS)1-
human_IL15Ra(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S XENP24306 Chain 1 - human_IL15_D30N/E64Q/N65D_(GGGGS)1-Fc(216)_IgG1_pI(-
)_Isosteric_A_C220S/PVA_/S267K/L368D/K370S/M428L/N434S
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVLHEALHSHYTQKSLSLSPGK (SEQ ID NO: 1221)

XENP24306 Chain 2 - human_IL15Ra(Sushi)_(GGGGS)1-
Fc(216)_IgG1_C220S/PVA_/S267K/S364K/E357Q/M428L/N434S
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVLHEALHSHYTQKSLSLS
PGK (SEQ ID NO: 1222)

Figure 135

D30N (SEQ ID NO: 1223)
NWVNVISDLKKIEDLIQSMHIDATLYTESNVHPSCKVTAMKCFLLELQVISLESGDASIHDTVENLII
LANNSLSSNGNVTESGCKECEELEEKNIKEFLQSFVHIVQMFINTS

N1D/D30N (SEQ ID NO: 1224)
DWVNVISDLKKIEDLIQSMHIDATLYTESNVHPSCKVTAMKCFLLELQVISLESGDASIHDTVENLII
LANNSLSSNGNVTESGCKECEELEEKNIKEFLQSFVHIVQMFINTS

N4D/D30N (SEQ ID NO: 1225)
NWVDVISDLKKIEDLIQSMHIDATLYTESNVHPSCKVTAMKCFLLELQVISLESGDASIHDTVENLII
LANNSLSSNGNVTESGCKECEELEEKNIKEFLQSFVHIVQMFINTS

D30N/E64Q (SEQ ID NO: 1226)
NWVNVISDLKKIEDLIQSMHIDATLYTESNVHPSCKVTAMKCFLLELQVISLESGDASIHDTVQNLII
LANNSLSSNGNVTESGCKECEELEEKNIKEFLQSFVHIVQMFINTS

D30N/N65D (SEQ ID NO: 1227)
NWVNVISDLKKIEDLIQSMHIDATLYTESNVHPSCKVTAMKCFLLELQVISLESGDASIHDTVEDLII
LANNSLSSNGNVTESGCKECEELEEKNIKEFLQSFVHIVQMFINTS

D30N/E64Q/N65D (SEQ ID NO: 1228)
NWVNVISDLKKIEDLIQSMHIDATLYTESNVHPSCKVTAMKCFLLELQVISLESGDASIHDTVQDLII
LANNSLSSNGNVTESGCKECEELEEKNIKEFLQSFVHIVQMFINTS

Figure 136A

>XENP29281 human_IL15Ra(sushi)_(GGGGS)5-human_IL15_D30N_(single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

XENP29281 Chain 1 - human_IL15Ra(sushi)_(GGGGS)5-human_IL15_D30N_(single-Chain)-Fc(216)_IgG1_pI(-)_Isosteric_A_C220S/PVA_/S267K/L368D/K370S (SEQ ID NO: 1229)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

XENP29281 Chain 2 - empty-Fc(216)_IgG1_C220S/PVA_/S267K/S364K/E357Q (SEQ ID NO: 1230)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP29282 human_IL15Ra(sushi)_(GGGGS)5-human_IL15_N1D/D30N_(single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

XENP29282 Chain 1 - human_IL15Ra(sushi)_(GGGGS)5-human_IL15_N1D/D30N_(single-Chain)-Fc(216)_IgG1_pI(-)_Isosteric_A_C220S/PVA_/S267K/L368D/K370S (SEQ ID NO: 1231)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/DWVNVISDLKKIEDLIQSMHIDATLYTESNVHPSCKVTAMKCFLLELQVISLESGDAS
IHDTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

XENP29282 Chain 2 - empty-Fc(216)_IgG1_C220S/PVA_/S267K/S364K/E357Q (SEQ ID NO: 1232)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP29283 human_IL15Ra(sushi)_(GGGGS)5-human_IL15_N4D/D30N_(single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

XENP29283 Chain 1 - human_IL15Ra(sushi)_(GGGGS)5-human_IL15_N4D/D30N_(single-Chain)-Fc(216)_IgG1_pI(-)_Isosteric_A_C220S/PVA_/S267K/L368D/K370S (SEQ ID NO: 1233)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESNVHPSCKVTAMKCFLLELQVISLESGDAS
IHDTVENLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

XENP29283 Chain 2 - empty-Fc(216)_IgG1_C220S/PVA_/S267K/S364K/E357Q (SEQ ID NO: 1234)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 136B

>XENP29284 human_IL15Ra(sushi)_(GGGGS)5-human_IL15_D30N/E64Q_(single-Chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q XENP29284 Chain 1 - human_IL15Ra(sushi)_(GGGGS)5-human_IL15_D30N/E64Q_(single-Chain)-
Fc(216)_IgG1_pI(-)_Isosteric_A_C220S/PVA_/S267K/L368D/K370S (SEQ ID NO: 1235)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQNLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK XENP29284 Chain 2 - empty-Fc(216)_IgG1_C220S/PVA_/S267K/S364K/E357Q (SEQ ID NO: 1236)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP29285 human_IL15Ra(sushi)_(GGGGS)5-human_IL15_D30N/N65D_(single-Chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q XENP29285 Chain 1 - human_IL15Ra(sushi)_(GGGGS)5-human_IL15_D30N/N65D_(single-Chain)-
Fc(216)_IgG1_pI(-)_Isosteric_A_C220S/PVA_/S267K/L368D/K370S (SEQ ID NO: 1237)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK XENP29285 Chain 2 - empty-Fc(216)_IgG1_C220S/PVA_/S267K/S364K/E357Q (SEQ ID NO: 1238)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >XENP29286 human_IL15Ra(sushi)_(GGGGS)5-human_IL15_D30N/E64Q/N65D_(single-Chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q XENP29286 Chain 1 - human_IL15Ra(sushi)_(GGGGS)5-human_IL15_D30N/E64Q/N65D_(single-Chain)-
Fc(216)_IgG1_pI(-)_Isosteric_A_C220S/PVA_/S267K/L368D/K370S (SEQ ID NO: 1239)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK XENP29286 Chain 2 - empty-Fc(216)_IgG1_pI(-)_Isosteric_A_C220S/PVA_/S267K/L368D/K370S (SEQ ID NO: 1240)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 138A

>XENP30453 human_IL15Ra(sushi)_(GGGGS)5-human_IL15(D30N/N65D;single-chain)-
MS[NKG2D]_H0L0_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S (SEQ ID NO: 1241)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - MS[NKG2D]_H0_IgG1_pI(-)_Isosteric_A_C220S/PVA_/S267K/L368D/K370S-
IgG1_PVA_/S267K/S364K/E357Q (SEQ ID NO: 1242)
QVHLQESGPGLVKPSETLSLTCTVSDDSI<u>SYYWS</u>WIRQPPGKGLEWIG<u>HISYSGSANYNPSLKS</u>RVTISVDTSK
NQFSLKLSSVTAADTAVYYCAN<u>WDDAFNI</u>WGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK

Chain 3 - MS[NKG2D]_L0 (SEQ ID NO: 1243)
EIVLTQSPGTLSLSPGERATLSC<u>RASQSVSSSYLA</u>WYQQKPGQAPRLLIY<u>GASSRAT</u>GIPDRFSGSGSGTDFTLT
ISRLEPEDFAVYYC<u>QQYGSSPWT</u>FGQGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC >XENP30593 human_IL15Ra(sushi)_(GGGGS)5-human_IL15(D30N/N65D;single-chain)-
1D7B4[NKG2D]_H1L1_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S (SEQ ID NO: 1244)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1D7B4[NKG2D]_H1_IgG1_PVA_/S267K/S364K/E357Q (SEQ ID NO: 1245)
EVQLLESGGGLVQPGGSLRLSCAASGFTFSS<u>YAMS</u>WVRQAPGKGLEWVS<u>SISASGGSTYYADSVKG</u>RFTISRDNS
KNTLYLQMNSLRAEDTAVYYCAK<u>GIFSIYFFYFDY</u>WGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVMHEALHNHYTQKSLSLSPG
K

Chain 3 - 1D7B4[NKG2D]_L1 (SEQ ID NO: 1246)
DIQMTQSPSSLSASVGDRVTITC<u>RASQSISSYLN</u>WYQQKPGKAPKLLIY<u>AASSLQS</u>GVPSRFSGSGSGTDFTLTI
SSLQPEDFATYYC<u>QQSYSTPYT</u>FGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 138B

>XENP30595 human_IL15Ra(sushi)_(GGGGS)5-human_IL15(D30N/N65D;single-chain)-mAb
A[NKG2D]_H1L1_IgG1_Fc(216)_IgG1_pI(-)_Isosteric_A_C220S/PVA_/S267K/L368D/K370S-
IgG1_PVA_/S267K/S364K/E357Q Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S (SEQ ID NO: 1247)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - mAb A[NKG2D]_H1_IgG1_PVA_/S267K/S364K/E357Q (SEQ ID NO: 1248)
QVQLVQSGAEVKKPGASVKVSCKVSGFSLTSYGVHWIRQAPGQGLEWMGVIWAGGSTNYNSKFQGRVTMTKDNSK
STVYMELSSLRSEDTAVYYCARGGYEGAAWFGYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK Chain 3 - mAb A[NKG2D]_L1 (SEQ ID NO: 1249)
DIQLTQSPSSLSASVGDRVTITCRASSSVSYMHWYQQKPGKSPKPLIYATSNLASGVPARFSGSGSGTDYTLTIS
SLQPEDFATYYCQQWNSNPLTFGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC >XENP31078 human_IL15Ra(sushi)_(GGGGS)5-human_IL15(D30N/N65D;single-chain)-mAb
A[NKG2D]_H1L1_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S Chain 1 - human_IL15Ra(sushi)_(GGGGS)5-human_IL15(D30N/N65 D;single-chain)_Fc(216)_IgG1_pI(-
)_Isosteric_A_C220S/PVA_/S267K/L368D/K370S/M428L/N434S (SEQ ID NO: 1250)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK Chain 2 - mAb A[NKG2D]_H1_IgG1_PVA_/S267K/S364K/E357Q/M428L/N434S (SEQ ID NO: 1251)
QVQLVQSGAEVKKPGASVKVSCKVSGFSLTSYGVHWIRQAPGQGLEWMGVIWAGGSTNYNSKFQGRVTMTKDNSK
STVYMELSSLRSEDTAVYYCARGGYEGAAWFGYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK

Figure 138C

Chain 3 - mAb A[NKG2D]_L1 (SEQ ID NO: 1252)
DIQLTQSPSSLSASVGDRVTITCRASSSVSYMHWYQQKPGKSPKPLIYATSNLASGVPARFSGSGSGTDYTLTIS
SLQPEDFATYYCQQWNSNPLTFGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

**>XENP31080 human_IL15Ra(sushi)_(GGGGS)5-human_IL15(D30N/N65D;single-chain)-
1D7B4[NKG2D]_H1L1_IgG1_Fc(216)_IgG1_pI(-
)_Isosteric_A_C220S/PVA_/S267K/L368D/K370S/M428L/N434S-
IgG1_PVA_/S267K/S364K/E357Q/M428L/N434S**

**Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S/M428L/N434S** (SEQ ID NO: 1253)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1D7B4[NKG2D]_H1_IgG1_PVA_/S267K/S364K/E357Q/M428L/N434S (SEQ ID NO: 1254)
EVQLLESGGGLVQPGGSLRLSCAASGFTFSSYAMSWVRQAPGKGLEWVSSISASGGSTYYADSVKGRFTISRDNS
KNTLYLQMNSLRAEDTAVYYCAKGIFSIYFFYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVLHEALHSHYTQKSLSLSPG
K

Chain 3 - 1D7B4[NKG2D]_L1 (SEQ ID NO: 1255)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPYTFGQGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 139A

>XENP30594 human_IL15Ra(sushi)_(GGGGS)5-human_IL15(D30N/E64Q/N65D;single-chain)-
1D7B4[NKG2D]_H1L1_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(D30N/E64Q/N65D;single-chain)_Fc(216)_IgG1_pI(-
)_Isosteric_A_C220S/PVA_/S267K/L368D/K370S** (SEQ ID NO: 1256)
ITCPPPMSVEHADIWVKSYSLYSRERYICNSGFKRKAGTSSLTECVLNKATNVAHWTTPSLKCIR/GGGGSGGGGSGGG
GSGGGGSGGGGS/NWVNVISDLKKIEDLIQSMHIDATLYTESNVHPSCKVTAMKCFLLELQVISLESGDASIHDTVQDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Chain 2 - 1D7B4[NKG2D]_H1_IgG1_PVA_/S267K/S364K/E357Q (SEQ ID NO: 1257)
EVQLLESGGGLVQPGGSLRLSCAASGFTFSSYAMSWVRQAPGKGLEWVSSISASGGSTYYADSVKGRFTISRDNSKNTL
YLQMNSLRAEDTAVYYCAKGIFSIYFFYFDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCPAP
PVAGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREQMTKNQVKLTCLVKGFYPSDIAVEWESNGQPENNY
KTTPPVLDSDGSFFLYSKLTVDKSRWQQGNVFSCSVMHEALHNHYTQKSLSLSPGK

Chain 3 - 1D7B4[NKG2D]_L1 (SEQ ID NO: 1258)
DIQMTQSPSSLSASVGDRVTITCRASQSISSYLNWYQQKPGKAPKLLIYAASSLQSGVPSRFSGSGSGTDFTLTISSLQ
PEDFATYYCQQSYSTPYTFGQGTKLEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC >XENP30596 human_IL15Ra(sushi)_(GGGGS)5-human_IL15(D30N/E64Q/N65D;single-chain)-mAb
A[NKG2D]_H1L1_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(D30N/E64Q/N65D;single-chain)_Fc(216)_IgG1_pI(-
)_Isosteric_A_C220S/PVA_/S267K/L368D/K370S** (SEQ ID NO: 1259)
ITCPPPMSVEHADIWVKSYSLYSRERYICNSGFKRKAGTSSLTECVLNKATNVAHWTTPSLKCIR/GGGGSGGGGSGGG
GSGGGGSGGGGS/NWVNVISDLKKIEDLIQSMHIDATLYTESNVHPSCKVTAMKCFLLELQVISLESGDASIHDTVQDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Chain 2 - mAb A[NKG2D]_H1_IgG1_PVA_/S267K/S364K/E357Q (SEQ ID NO: 1260)
QVQLVQSGAEVKKPGASVKVSCKVSGFSLTSYGVHWIRQAPGQGLEWMGVIWAGGSTNYNSKFQGRVTMTKDNSKSTVY
MELSSLRSEDTAVYYCARGGYEGAAWFGYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK

Chain 3 - mAb A[NKG2D]_L1 (SEQ ID NO: 1261)
DIQLTQSPSSLSASVGDRVTITCRASSSVSYMHWYQQKPGKSPKPLIYATSNLASGVPARFSGSGSGTDYTLTISSLQP
EDFATYYCQQWNSNPLTFGAGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 139B

>XENP31079 human_IL15Ra(sushi)_(GGGGS)5-human_IL15(D30N/E64Q/N65D;single-chain)-mAb A[NKG2D]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S/M428L/N434S (SEQ ID NO: 1262)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - mAb A[NKG2D]_H1_IgG1_PVA_/S267K/S364K/E357Q/M428L/N434S (SEQ ID NO: 1263)
QVQLVQSGAEVKKPGASVKVSCKVSGFSLTSYGVHWIRQAPGQGLEWMGVIWAGGSTNYNSKFQGRVTMTKDNSK
STVYMELSSLRSEDTAVYYCARGGYEGAAWFGYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK

Chain 3 - mAb A[NKG2D]_L1 (SEQ ID NO: 1264)
DIQLTQSPSSLSASVGDRVTITCRASSSVSYMHWYQQKPGKSPKPLIYATSNLASGVPARFSGSGSGTDYTLTIS
SLQPEDFATYYCQQWNSNPLTFGAGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

>XENP31081 human_IL15Ra(sushi)_(GGGGS)5-human_IL15(D30N/E64Q/N65D;single-chain)-1D7B4[NKG2D]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S/M428L/N434S (SEQ ID NO: 1265)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1D7B4[NKG2D]_H1_IgG1_PVA_/S267K/S364K/E357Q/M428L/N434S (SEQ ID NO: 1266)
EVQLLESGGGLVQPGGSLRLSCAASGFTFSSYAMSWVRQAPGKGLEWVSSISASGGSTYYADSVKGRFTISRDNS
KNTLYLQMNSLRAEDTAVYYCAKGIFSIYFFYFDYWGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVLHEALHSHYTQKSLSLSPG
K

Figure 139C

Chain 3 - 1D7B4[NKG2D]_L1 (SEQ ID NO: 1267)
DIQMTQSPSSLSASVGDRVTITC<u>RASQSISSYLN</u>WYQQKPGKAPKLLIY<u>AASSLQS</u>GVPSRFSGSGSGTDFTLTISSLQ
PEDFATYYC<u>QQSYSTPYT</u>FGQGTKLEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

**>XENP33332 human_IL15Ra(sushi)_(GGGGS)5-human_IL15(D30N/E64Q/N65D;single-chain)-
MS[NKG2D]_H0L0_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S**

**Chain 1 - human_IL15Ra(sushi)_(GGGGS)5-human_IL15(D30N/E64Q/N65D;single-chain)_IgG1_pI(-
)_Isosteric_A_C220S/PVA_/S267K/L368D/K370S/M428L/N434S** (SEQ ID NO: 1268)
ITCPPPMSVEHADIWVKSYSLYSRERYICNSGFKRKAGTSSLTECVLNKATNVAHWTTPSLKCIR/<u>GGGGSGGGGSGGG
GSGGGGSGGGGS</u>/NWVNVISDLKKIEDLIQSMHIDATLYTESNVHPSCKVTAMKCFLLELQVISLESGDASIHDTVQDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVLHEALHSHYTQKSLSLSPGK

Chain 2 - MS[NKG2D]_H0_IgG1_PVA_/S267K/S364K/E357Q/M428L/N434S (SEQ ID NO: 1269)
QVHLQESGPGLVKPSETLSLTCTVSDDSIS<u>SYYWS</u>WIRQPPGKGLEWIG<u>HISYSGSANYNPSLKS</u>RVTISVDTSKNQFS
LKLSSVTAADTAVYYCANW<u>DDAFNI</u>WGQGTMVTVSS/ASTKGPSVFPLAPSSKSTSGGTAALGCLVKDYFPEPVTVSWN
SGALTSGVHTFPAVLQSSGLYSLSSVVTVPSSSLGTQTYICNVNHKPSNTKVDKKVEPKSCDKTHTCPPCPAPPVAGPS
VFLFPPKPKDTLMISRTPEVTCVVVDVKHEDPEVKFNWYVDGVEVHNAKTKPREEQYNSTYRVVSVLTVLHQDWLNGKE
YKCKVSNKALPAPIEKTISKAKGQPREPQVYTLPPSREQMTKNQVKLTCLVKGFYPSDIAVEWESNGQPENNYKTTPPV
LDSDGSFFLYSKLTVDKSRWQQGNVFSCSVLHEALHSHYTQKSLSLSPGK

Chain 3- MS[NKG2D]_L0 (SEQ ID NO: 1270)
EIVLTQSPGTLSLSPGERATLSC<u>RASQSVSSSYLA</u>WYQQKPGQAPRLLIY<u>GASSRAT</u>GIPDRFSGSGSGTDFTLTISRL
EPEDFAVYYC<u>QQYGSSPWT</u>FGQGTKVEIK/RTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

**>XENP33334 human_IL15Ra(sushi)_(GGGGS)5-human_IL15(D30N/E64Q/N65D;single-chain)-mAb
C[NKG2D]_H2L1_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S**

**Chain 1 - human_IL15Ra(sushi)_(GGGGS)5-human_IL15(D30N/E64Q/N65D;single-chain)_IgG1_pI(-
)_Isosteric_A_C220S/PVA_/S267K/L368D/K370S/M428L/N434S** (SEQ ID NO: 1271)
ITCPPPMSVEHADIWVKSYSLYSRERYICNSGFKRKAGTSSLTECVLNKATNVAHWTTPSLKCIR/<u>GGGGSGGGGSGGG
GSGGGGSGGGGS</u>/NWVNVISDLKKIEDLIQSMHIDATLYTESNVHPSCKVTAMKCFLLELQVISLESGDASIHDTVQDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVLHEALHSHYTQKSLSLSPGK

Chain 2 - mAb C[NKG2D]_H2_IgG1_PVA_/S267K/S364K/E357Q/M428L/N434S (SEQ ID NO: 1272)
EVQLVESGGGLVQPGGSLRLSCAVSGFSLT<u>IYGVHW</u>VRQAPGKGLEWVSV<u>IWSGGSTDYNAKV</u>KGRFTISKDNSKRTVY
LQMNSLRAEDTAVYYCSRK<u>SHDGYYGVMDY</u>WGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK

Chain 3- mAb C[NKG2D]_L1 (SEQ ID NO: 1273)
DIQLTQSPDFQSVTPKEKVTITC<u>RASQSIGTSIHW</u>YQQKPDQSPKLLIK<u>YASESIS</u>GIPSRFSGSGSGTDFTLTINSLE
AEDAATYYC<u>QQSNTWPLT</u>FGAGTKVEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 139D

>XENP33336 human_IL15Ra(sushi)_(GGGGS)5-human_IL15(D30N/E64Q/N65D;single-chain)-mAb E[NKG2D]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S/M428L/N434S (SEQ ID NO: 1274)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - mAb E[NKG2D]_H1_IgG1_PVA_/S267K/S364K/E357Q/M428L/N434S (SEQ ID NO: 1275)
EVQLVESGGGLVKPGGSLRLSCAASGFTFSS<u>YSMN</u>WVRQAPGKGLEWVS<u>SITSSSSYIYYADSVKG</u>RFTISRDNA
KNSLYLQMNSLRAEDTAVYYCAR<u>DRRYFDWFPLDY</u>RGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVLHEALHSHYTQKSLSLSPG
K

Chain 3- mAb E[NKG2D]_L1 (SEQ ID NO: 1276)
DIQMTQSPSSLSASVGDRVTITC<u>RASQGISSWLA</u>WYQQKPEKAPKSLIY<u>AASSLQS</u>GVPSRFSGSGSGTDFTLTI
SSLQPEDFATYYC<u>QQYNGYPYT</u>FGQGTKLEIKR/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP33338 human_IL15Ra(sushi)_(GGGGS)5-human_IL15(D30N/E64Q/N65D;single-chain)-16F31[NKG2D]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S/M428L/N434S (SEQ ID NO: 1277)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 16F31[NKG2D]_H1_IgG1_PVA_/S267K/S364K/E357Q/M428L/N434S (SEQ ID NO: 1278)
EVQLVESGGGVVRPGGSLRLSCAASGFTFD<u>DYGMT</u>WVRQAPGKGLEWVSG<u>INWNGGSTGYADSVKG</u>RFTISRDNA
KNSLYLQMNSLRAEDTALYYCARE<u>RELYYYYGLD</u>VWGQGTTVTVSS/ASTKGPSVFPLAPSSKSTSGGTAALGC
LVKDYFPEPVTVSWNSGALTSGVHTFPAVLQSSGLYSLSSVVTVPSSSLGTQTYICNVNHKPSNTKVDKKVEPKS
CDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVLHEALHSHYTQKSLSLSP
GK

Chain 3- 16F31[NKG2D]_L1 (SEQ ID NO: 1279)
EIVLTQSPGTLSLSPGERATLSC<u>RASQSVSSSYLA</u>WYQQKPGQAPRLLIY<u>GASSRAT</u>GIPDRFSGSGSGTDFTLT
ISRLEPEDFAVYYC<u>QQYGSSPFT</u>FGPGTKVDIKR/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 139E

>XENP33340 human_IL15Ra(sushi)_(GGGGS)5-human_IL15(D30N/E64Q/N65D;single-chain)-KYK-1.0[NKG2D]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S/M428L/N434S (SEQ ID NO: 1280)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - KYK-1.0[NKG2D]_H1_IgG1_PVA_/S267K/S364K/E357Q/M428L/N434S (SEQ ID NO: 1281)
EVQLVESGGGVVQPGGSLRLSCAASGFTFSSYGMHWVRQAPGKGLEWVAFIRYDGSNKYYADSVKGRFTISRDNS
KNTKYLQMNSLRAEDTAVYYCAKDRFGYYLDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK

Chain 3- KYK-1.0[NKG2D]_L1 (SEQ ID NO: 1282)
QPVLTQPSSVSVAPGETARIPCGGDDIETKSVHWYQQKPGQAPVLVIYDDDDRPSGIPERFFGSNSGNTATLSIS
RVEAGDEADYYCQVWDDNNDEWVFGGGTQLTVLGQPKAAPSVTLFPPSSEELQANKATLVCLISDFYPGAVTVAW
KADSSPVKAGVETTTPSKQSNNKYAASSYLSLTPEQWKSHRSYSCQVTHEGSTVEKTVAPTECS >XENP33342 human_IL15Ra(sushi)_(GGGGS)5-human_IL15(D30N/E64Q/N65D;single-chain)-KYK-2.0[NKG2D]_H0L0_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S/M428L/N434S (SEQ ID NO: 1283)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - KYK-2.0[NKG2D]_H0_IgG1_PVA_/S267K/S364K/E357Q/M428L/N434S (SEQ ID NO: 1284)
QVQLVESGGGLVKPGGSLRLSCAASGFTFSSYGMHWVRQAPGKGLEWVAFIRYDGSNKYYADSVKGRFTISRDNS
KNTKYLQMNSLRAEDTAVYYCAKDRGLGDGTYFDYWGQGTTVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVLHEALHSHYTQKSLSLSPG
K

Chain 3- KYK-2.0[NKG2D]_L1 (SEQ ID NO: 1285)
QSALTQPASVSGSPGQSITISCSGSSSNIGNNAVNWYQQLPGKAPKLLIYYDDLLPSGVSDRFSGSKSGTSAFLA
ISGLQSEDEADYYCAAWDDSLNGPVFGGGTKLTVLGQPKAAPSVTLFPPSSEELQANKATLVCLISDFYPGAVTV
AWKADSSPVKAGVETTTPSKQSNNKYAASSYLSLTPEQWKSHRSYSCQVTHEGSTVEKTVAPTECS

Figure 139F

>XENP33344 human_IL15Ra(sushi)_(GGGGS)5-human_IL15(D30N/E64Q/N65D;single-chain)-mAb B[NKG2D]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S/M428L/N434S (SEQ ID NO: 1286)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - mAb B[NKG2D]_H1_IgG1_PVA_/S267K/S364K/E357Q/M428L/N434S (SEQ ID NO: 1287)
QVQLVQSGAEVKKPGASVKVSCKASGYTFTSYWMNWVRQAPGQGLEWMGRIDPYDSETHYNQKFQGRVTMTVDKS
TSTAYMELSSLRSEDTAVYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3- mAb B[NKG2D]_L1 (SEQ ID NO: 1288)
DIQLTQSPSSLSASVGDRVTITCRASGNIHNYLAWYQQKPGKSPKVLVYNAKTLADGVPSRFSGSGSGTDYTLTI
SSLQPEDFATYYCQHFWSTTWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC >XENP33346 human_IL15Ra(sushi)_(GGGGS)5-human_IL15(D30N/E64Q/N65D;single-chain)-mAb D[NKG2D]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S/M428L/N434S (SEQ ID NO: 1289)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - mAb D[NKG2D]_H1_IgG1_PVA_/S267K/S364K/E357Q/M428L/N434S (SEQ ID NO: 1290)
QVQLVQSGAEVKKPGASVKVSCKASGYTFTNYWMHWVRQAPGQGLEWMGEIDPSDIYTNYAQKFQGRVTMTRDTS
TSTVYMELSSLRSEDTAVYYCARGIYDGYYVYGMDYWGQGTTVTVSS/ASTKGPSVFPLAPSSKSTSGGTAALGC
LVKDYFPEPVTVSWNSGALTSGVHTFPAVLQSSGLYSLSSVVTVPSSSLGTQTYICNVNHKPSNTKVDKKVEPKS
CDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVLHEALHSHYTQKSLSLSP
GK

Chain 3- mAb D[NKG2D]_L1 (SEQ ID NO: 1291)
YIQMTQSPSSLSASVGDRVTITCRSSQDISNYLNWYQQKPGKAPKLLIYYTSRLHSGVPSRFSGSGSGTDFTFTI
SSLQPEDIATYYCQQGKTLPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 139G

>XENP33350 human_IL15Ra(sushi)_(GGGGS)5-human_IL15(D30N/E64Q/N65D;single-chain)-MS[NKG2D]_H0L0_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S (SEQ ID NO: 1292)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - MS[NKG2D]_H0_IgG1_PVA_/S267K/S364K/E357Q (SEQ ID NO: 1293)
QVHLQESGPGLVKPSETLSLTCTVSDDSISSYYWSWIRQPPGKGLEWIGHISYSGSANYNPSLKSRVTISVDTSK
NQFSLKLSSVTAADTAVYYCANWDDAFNIWGQGTMVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTC
PPCPAPPVAGPSVFLFPPKPKDTLMISRTPEVTCVVVDVKHEDPEVKFNWYVDGVEVHNAKTKPREEQYNSTYRV
VSVLTVLHQDWLNGKEYKCKVSNKALPAPIEKTISKAKGQPREPQVYTLPPSREQMTKNQVKLTCLVKGFYPSDI
AVEWESNGQPENNYKTTPPVLDSDGSFFLYSKLTVDKSRWQQGNVFSCSVMHEALHNHYTQKSLSLSPGK

Chain 3- MS[NKG2D]_L0 (SEQ ID NO: 1294)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPWTFGQGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP33352 human_IL15Ra(sushi)_(GGGGS)5-human_IL15(D30N/E64Q/N65D;single-chain)-mAb C[NKG2D]_H2L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S (SEQ ID NO: 1295)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - mAb C[NKG2D]_H2_IgG1_PVA_/S267K/S364K/E357Q (SEQ ID NO: 1296)
EVQLVESGGGLVQPGGSLRLSCAVSGFSLTIYGVHWVRQAPGKGLEWVSVIWSGGSTDYNAKVKGRFTISKDNSK
RTVYLQMNSLRAEDTAVYYCSRKSHDGYYGVMDYWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain 3- mAb C[NKG2D]_L1 (SEQ ID NO: 1297)
DIQLTQSPDFQSVTPKEKVTITCRASQSIGTSIHWYQQKPDQSPKLLIKYASESISGIPSRFSGSGSGTDFTLTI
NSLEAEDAATYYCQQSNTWPLTFGAGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 139H

>XENP33354 human_IL15Ra(sushi)_(GGGGS)5-human_IL15(D30N/E64Q/N65D;single-chain)-mAb E[NKG2D]_H1L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S (SEQ ID NO: 1298)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - mAb E[NKG2D]_H1_IgG1_PVA_/S267K/S364K/E357Q (SEQ ID NO: 1299)
EVQLVESGGGLVKPGGSLRLSCAASGFTFSSYSMNWVRQAPGKGLEWVSSITSSSSYIYYADSVKGRFTISRDNA
KNSLYLQMNSLRAEDTAVYYCARDRRYFDWFPLDYRGQGTLVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVMHEALHNHYTQKSLSLSPG
K

Chain 3- mAb E[NKG2D]_L1 (SEQ ID NO: 1300)
DIQMTQSPSSLSASVGDRVTITCRASQGISSWLAWYQQKPEKAPKSLIYAASSLQSGVPSRFSGSGSGTDFTLTI
SSLQPEDFATYYCQQYNGYPYTFGQGTKLEIKR/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

>XENP33356 human_IL15Ra(sushi)_(GGGGS)5-human_IL15(D30N/E64Q/N65D;single-chain)-16F31[NKG2D]_H1L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S (SEQ ID NO: 1301)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 16F31[NKG2D]_H1_IgG1_PVA_/S267K/S364K/E357Q (SEQ ID NO: 1302)
EVQLVESGGGVVRPGGSLRLSCAASGFTFDDYGMTWVRQAPGKGLEWVSGINWNGGSTGYADSVKGRFTISRDNA
KNSLYLQMNSLRAEDTALYYCARERELYYYYGLDVWGQGTTVTVSS/ASTKGPSVFPLAPSSKSTSGGTAALGC
LVKDYFPEPVTVSWNSGALTSGVHTFPAVLQSSGLYSLSSVVTVPSSSLGTQTYICNVNHKPSNTKVDKKVEPKS
CDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSP
GK

Chain 3- 16F31[NKG2D]_L1 (SEQ ID NO: 1303)
EIVLTQSPGTLSLSPGERATLSCRASQSVSSSYLAWYQQKPGQAPRLLIYGASSRATGIPDRFSGSGSGTDFTLT
ISRLEPEDFAVYYCQQYGSSPFTFGPGTKVDIKR/RTVAAPSVFIFPPSDEQLKSGTASVVCLLNNFYPREAKVQ
WKVDNALQSGNSQESVTEQDSKDSTYSLSSTLTLSKADYEKHKVYACEVTHQGLSSPVTKSFNRGEC

Figure 139I

>XENP33358 human_IL15Ra(sushi)_(GGGGS)5-human_IL15(D30N/E64Q/N65D;single-chain)-KYK-
1.0[NKG2D]_H1L1_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(D30N/E64Q/N65D;single-chain)_IgG1_pI(-
)_Isosteric_A_C220S/PVA_/S267K/L368D/K370S** (SEQ ID NO: 1304)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - KYK-1.0[NKG2D]_H1_IgG1_PVA_/S267K/S364K/E357Q (SEQ ID NO: 1305)
EVQLVESGGGVVQPGGSLRLSCAASGFTFSSYGMHWVRQAPGKGLEWVAFIRYDGSNKYYADSVKGRFTISRDNS
KNTKYLQMNSLRAEDTAVYYCAKDRFGYYLDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK

Chain 3- KYK-1.0[NKG2D]_L1 (SEQ ID NO: 1306)
QPVLTQPSSVSVAPGETARIPCGGDDIETKSVHWYQQKPGQAPVLVIYDDDDRPSGIPERFFGSNSGNTATLSIS
RVEAGDEADYCQVWDDNNDEWVFGGGTQLTVLGQPKAAPSVTLFPPSSEELQANKATLVCLISDFYPGAVTVAW
KADSSPVKAGVETTTPSKQSNNKYAASSYLSLTPEQWKSHRSYSCQVTHEGSTVEKTVAPTECS >XENP33360 human_IL15Ra(sushi)_(GGGGS)5-human_IL15(D30N/E64Q/N65D;single-chain)-KYK-
2.0[NKG2D]_H0L0_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(D30N/E64Q/N65D;single-chain)_IgG1_pI(-
)_Isosteric_A_C220S/PVA_/S267K/L368D/K370S** (SEQ ID NO: 1307)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - KYK-2.0[NKG2D]_H0_IgG1_PVA_/S267K/S364K/E357Q (SEQ ID NO: 1308)
QVQLVESGGGLVKPGGSLRLSCAASGFTFSSYGMHWVRQAPGKGLEWVAFIRYDGSNKYYADSVKGRFTISRDNS
KNTKYLQMNSLRAEDTAVYYCAKDRGLGDGTYFDYWGQGTTVTVSS/ASTKGPSVFPLAPSSKSTSGGTAALGCL
VKDYFPEPVTVSWNSGALTSGVHTFPAVLQSSGLYSLSSVVTVPSSSLGTQTYICNVNHKPSNTKVDKKVEPKSC
DKTHTCPPCPAPPVAGPSVFLFPPKPKDTLMISRTPEVTCVVVDVKHEDPEVKFNWYVDGVEVHNAKTKPREEQY
NSTYRVVSVLTVLHQDWLNGKEYKCKVSNKALPAPIEKTISKAKGQPREPQVYTLPPSREQMTKNQVKLTCLVKG
FYPSDIAVEWESNGQPENNYKTTPPVLDSDGSFFLYSKLTVDKSRWQQGNVFSCSVMHEALHNHYTQKSLSLSPG
K

Chain 3- KYK-2.0[NKG2D]_L1 (SEQ ID NO: 1309)
QSALTQPASVSGSPGQSITISCSGSSSNIGNNAVNWYQQLPGKAPKLLIYYDDLLPSGVSDRFSGSKSGTSAFLA
ISGLQSEDEADYYCAAWDDSLNGPVFGGGTKLTVLGQPKAAPSVTLFPPSSEELQANKATLVCLISDFYPGAVTV
AWKADSSPVKAGVETTTPSKQSNNKYAASSYLSLTPEQWKSHRSYSCQVTHEGSTVEKTVAPTECS

Figure 139J

>XENP33362_human_IL15Ra(sushi)_(GGGGS)5-human_IL15(D30N/E64Q/N65D;single-chain)-mAb B[NKG2D]_H1L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S (SEQ ID NO: 1310)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - mAb B[NKG2D]_H1_IgG1_PVA_/S267K/S364K/E357Q (SEQ ID NO: 1311)
QVQLVQSGAEVKKPGASVKVSCKASGYTFTSYWMNWVRQAPGQGLEWMGRIDPYDSETHYNQKFQGRVTMTVDKS
TSTAYMELSSLRSEDTAVYYCAKMGDYSFDYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3- mAb B[NKG2D]_L1 (SEQ ID NO: 1312)
DIQLTQSPSSLSASVGDRVTITCRASGNIHNYLAWYQQKPGKSPKVLVYNAKTLADGVPSRFSGSGSGTDYTLTI
SSLQPEDFATYYCQHFWSTTWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC >XENP33364_human_IL15Ra(sushi)_(GGGGS)5-human_IL15(D30N/E64Q/N65D;single-chain)-mAb D[NKG2D]_H1L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_IgG1_pI(-)_Isosteric_A_C220S/PVA_/S267K/L368D/K370S (SEQ ID NO: 1313)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - mAb D[NKG2D]_H1_IgG1_PVA_/S267K/S364K/E357Q (SEQ ID NO: 1314)
QVQLVQSGAEVKKPGASVKVSCKASGYTFTNYWMHWVRQAPGQGLEWMGEIDPSDIYTNYAQKFQGRVTMTRDTS
TSTVYMELSSLRSEDTAVYYCARGIYDGYYVYGMDYWGQGTTVTVSS/ASTKGPSVFPLAPSSKSTSGGTAALGC
LVKDYFPEPVTVSWNSGALTSGVHTFPAVLQSSGLYSLSSVVTVPSSSLGTQTYICNVNHKPSNTKVDKKVEPKS
CDKTHTCPPCPAPPVAGPSVFLFPPKPKDTLMISRTPEVTCVVVDVKHEDPEVKFNWYVDGVEVHNAKTKPREEQ
YNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSP
GK

Chain 3- mAb D[NKG2D]_L1 (SEQ ID NO: 1315)
YIQMTQSPSSLSASVGDRVTITCRSSQDISNYLNWYQQKPGKAPKLLIYYTSRLHSGVPSRFSGSGSGTDFTFTI
SSLQPEDIATYYCQQGKTLPRTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 140A

>XENP26007 human_IL15Ra(sushi)_(GGGGS)5-human_IL15(N4D/N65D;single-Chain)-Numax_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S scIL-15/Rα-Fc Chain (SEQ ID NO: 1316)
[0008]    *ITCPPPMSVEHADIWVKSYSLYSRERYICNSGFKRKAGTSSSLTECVLNKATNVAHWTTPSLKC
IR*/GGGGSGGGGSGGGGSGGGGSGGGGS/NWVDVISDLKKIEDLIQSMHIDATLYTESDVHPSCKVTAMKCFLLE
LQVISLESGDASIHDTVEDLIILANNSLSSNGNVTESGCKECEELEEKNIKEFLQSFVHIVQMFINTS/EPKSSD
KTHTCPPCPAPPVAGPSVFLFPPKPKDTLMISRTPEVTCVVVDVKHEDPEVKFNWYVDGVEVHNAKTKPREEEYN
STYRVVSVLTVLHQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHNHYTQKSLSLSPGK

Chain 2 - Numax_IgG1_PVA_/S267K/S364K/E357Q Heavy Chain (SEQ ID NO: 1317)
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain 3 - Numax Light Chain (SEQ ID NO: 1318)
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

>XENP30362 human_IL15Ra(sushi)_(GGGGS)5-human_IL15(N4D/N65D;single-Chain)-Numax_IgG1_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S/M428L/N434S scIL-15/Rα-Fc Chain (SEQ ID NO: 1319)
[0009]    *ITCPPPMSVEHADIWVKSYSLYSRERYICNSGFKRKAGTSSSLTECVLNKATNVAHWTTPSLKCIR*/GGG
GSGGGGSGGGGSGGGGSGGGGS/NWVDVISDLKKIEDLIQSMHIDATLYTESDVHPSCKVTAMKCFLLELQVISL
ESGDASIHDTVEDLIILANNSLSSNGNVTESGCKECEELEEKNIKEFLQSFVHIVQMFINTS/EPKSSDKTHTCP
PCPAPPVAGPSVFLFPPKPKDTLMISRTPEVTCVVVDVKHEDPEVKFNWYVDGVEVHNAKTKPREEEYNSTYRVV
SVLTVLHQDWLNGKEYKCKVSNKALPAPIEKTISKAKGQPREPQVYTLPPSREEMTKNQVSLTCDVSGFYPSDIA
VEWESDGQPENNYKTTPPVLDSDGSFFLYSKLTVDKSRWEQGDVFSCSVLHEALHSHYTQKSLSLSPGK

Chain 2 - Numax_IgG1_PVA_/S267K/S364K/E357Q/M428L/N434S Heavy Chain (SEQ ID NO: 1320)
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK

Chain 3 - Numax Light Chain (SEQ ID NO: 1321)
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

Figure 140B

>XENP29481 human_IL15Ra(sushi)_(GGGGS)5-human_IL15(D30N/N65D;single-chain)-Numax_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 1322)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - Numax_IgG1_PVA_/S267K/S364K/E357Q (SEQ ID NO: 1323)
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain 3 - Numax LC (SEQ ID NO: 1324)
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

>XENP30363 human_IL15Ra(sushi)_(GGGGS)5-human_IL15(D30N/N65D;single-chain)-Numax_IgG1_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S/M428L/N434S (SEQ ID NO: 1325)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - Numax_IgG1_PVA_/S267K/S364K/E357Q/M428L/N434S (SEQ ID NO: 1326)
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK

Chain 3 - Numax LC (SEQ ID NO: 1327)
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

Figure 140C

>XENP30432 human_IL15Ra(sushi)_(GGGGS)5-human_IL15(D30N/E64Q/N65D;single-chain)-Numax_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 1328)
ITCPPPMSVEHADIWVKSYSLYSRERYICNSGFKRKAGTSSLTECVLNKATNVAHWTTPSLKCIR/GGGGSGGGGSGGG
GSGGGGSGGGGS/NWVNVISDLKKIEDLIQSMHIDATLYTESNVHPSCKVTAMKCFLLELQVISLESGDASIHDTVQDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVMHEALHNHYTQKSLSLSPGK

Chain 2 - Numax_VH_IgG1_IgG1_PVA_/S267K/S364K/E357Q (SEQ ID NO: 1329)
QVTLRESGPALVKPTQTLTLTCTFSGFSLSTAGMSVGWIRQPPGKALEWLADIWWDDKKHYNPSLKDRLTISKDTSKNQ
VVLKVTNMDPADTATYYCARDMIFNFYFDVWGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK

Chain 3 - Numax LC (SEQ ID NO: 1330)
DIQMTQSPSTLSASVGDRVTITCSASSRVGYMHWYQQKPGKAPKLLIYDTSKLASGVPSRFSGSGSGTEFTLTISSLQP
DDFATYYCFQGSGYPFTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP30518 human_IL15Ra(sushi)_(GGGGS)5-human_IL15(D30N/E64Q/N65D;single-chain)-Numax_IgG1_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S/M428L/N434S (SEQ ID NO: 1331)
ITCPPPMSVEHADIWVKSYSLYSRERYICNSGFKRKAGTSSLTECVLNKATNVAHWTTPSLKCIR/GGGGSGGGGSGGG
GSGGGGSGGGGS/NWVNVISDLKKIEDLIQSMHIDATLYTESNVHPSCKVTAMKCFLLELQVISLESGDASIHDTVQDL
IILANNSLSSNGNVTESGCKECEELEEKNIKEFLQSFVHIVQMFINTS/EPKSSDKTHTCPPCPAPPVAGPSVFLFPPK
PKDTLMISRTPEVTCVVVDVKHEDPEVKFNWYVDGVEVHNAKTKPREEEYNSTYRVVSVLTVLHQDWLNGKEYKCKVSN
KALPAPIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVLHEALHSHYTQKSLSLSPGK

Chain 2 - Numax_VH_IgG1_IgG1_PVA_/S267K/S364K/E357Q/M428L/N434S (SEQ ID NO: 1332)
QVTLRESGPALVKPTQTLTLTCTFSGFSLSTAGMSVGWIRQPPGKALEWLADIWWDDKKHYNPSLKDRLTISKDTSKNQ
VVLKVTNMDPADTATYYCARDMIFNFYFDVWGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK

Chain 3 - Numax LC (SEQ ID NO: 1333)
DIQMTQSPSTLSASVGDRVTITCSASSRVGYMHWYQQKPGKAPKLLIYDTSKLASGVPSRFSGSGSGTEFTLTISSLQP
DDFATYYCFQGSGYPFTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

A)

B)

C)

A)

B)

A)

B)

C)

D)

A)

B)

A)

B)

TARGETED HETERODIMERIC FC FUSION PROTEINS CONTAINING IL-15/IL-15RA AND NKG2D ANTIGEN BINDING DOMAINS

CROSS REFERENCE TO RELATED APPLICATIONS

This application claims priority to U.S. Provisional Application No. 62/783,106, filed Dec. 20, 2018, which is hereby incorporated by reference in its entirety.

SEQUENCE LISTING

The instant application contains a Sequence Listing which has been submitted electronically in ASCII format and is hereby incorporated by reference in its entirety. Said ASCII copy, created on Feb. 28, 2020, is named 067461-5236-US_SL.txt and is 1,751,618 bytes in size.

BACKGROUND OF THE INVENTION

IL-2 and IL-15 function in aiding the proliferation and differentiation of B cells, T cells, and NK cells. Both cytokines exert their cell signaling function through binding to a trimeric complex consisting of two shared receptors, the common gamma chain (γc; CD132) and IL-2 receptor B-chain (IL-2Rβ; CD122), as well as an alpha chain receptor unique to each cytokine: IL-2 receptor alpha (IL-2Rα; CD25) or IL-15 receptor alpha (IL-15Rα; CD215). Both cytokines are considered as potentially valuable therapeutics in oncology and IL-2 has been approved for use in patients with metastatic renal-cell carcinoma and malignant melanoma. Currently, there are no approved uses of recombinant IL-15, although several clinical trials are ongoing.

IL-2 preferentially proliferates T cells that display the high affinity receptor complex (i.e. IL-2Rα/β/γ complex). Because regulatory T cells (Tregs; CD4+CD25$^{high}$Foxp3+) constitutively express IL-2Rα (CD25), T cell proliferation by IL-2 is skewed in favor of Tregs which suppresses the immune response and is therefore unfavorable for oncology treatment. This imbalance has led to the concept of high dose IL-2; however, this approach creates additional problems because of IL-2 mediated toxicities such as vascular leak syndrome.

In contrast, IL-15 is primarily presented as a membrane-bound heterodimeric complex with IL-15Rα on monocytes and dendritic cells, and its effects are realized through trans-presentation of the IL-15/IL-15Rα complex to the intermediate affinity receptor complex (i.e., IL-2Rβ/γ complex), which are found for example on NK cells and CD8+ T cells. However, while the IL-15/IL-15Rα complex does not skew in favor of Tregs, the complex still contributes to Treg proliferation which as discussed above is unfavorable for oncology treatment. Therefore, there remains an unmet need in oncology treatment for therapeutic strategies which skew in favor of CD8+ T cell proliferation and activation. Furthermore, a high CD8/CD4 T cell ratio in TILs is generally considered a good prognostic marker for tumor therapy. Stimulation and proliferation of CD4 effector T cells is also thought to contribute to greater amounts of cytokine release compared to CD8 effectors, and lessening this effect could make IL-15 treatment safer with less side effects. The present invention addresses this need by providing novel targeted IL-15/Rα-Fc fusion heterodimeric proteins proteins which steer IL-15 preferentially towards CD8+ T cells.

BRIEF SUMMARY OF THE INVENTION

In some aspects, the present invention provides a targeted heterodimeric protein comprising:
a) a first monomer comprising, from N- to C-terminal:
  i) a human IL-15Rα(sushi) domain;
  ii) a first domain linker;
  iii) a variant of human IL-15 comprising the amino acid sequence of SEQ ID NO:2 and one or more amino acid substitutions selected from the group consisting of N1D, N4D, D8N, D30N, D61N, E64Q, N65D, and Q108E;
  iv) a second domain linker; and
  v) a first variant Fc domain; and
b) a second monomer comprising, from N- to C-terminal:
  i) a NKG2D antigen binding domain (ABD); and
  ii) a second variant Fc domain.

In some embodiments, the NKG2D ABD comprises a variable heavy and light domain pair selected from the group consisting of MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]_H2L2, mAb D[NKG2D]_H1L1, and mAb E[NKG2D]_H1L1.

In some embodiments, the variant of human IL-15 has amino acid substitutions selected from the group consisting of N4D/N65D, D30N/N65D, D30N/E64Q/N65D, N1D, N4D, D8N, D30N, D61N, E64Q, N65D, Q108E, N1D/D61N, N1D/E64Q, N4D, D61N, N4D/E64Q, D8N/D61N, D8N/E64Q, D61N/E64Q, E64Q/Q108E, N1D/N4D/D8N, D61N/E64Q/N65Q, N1D/D61N/E64Q/Q108E, N4D/D61N/E64Q/Q108E, N1D/N65D, D30N/Q108E, N65D/Q108E, E64Q/N65D, N1D/N4D/N65D, and N4D/D61N/N65D.

In some embodiments, the IL-15Rα(sushi) domain comprises the amino acid sequence of SEQ ID NO:4.

In some embodiments, the NKG2D antigen binding domain is a single chain variable fragment (scFv) or a Fab fragment.

In some embodiments, the first Fc domain and said second Fc domain have a set of amino acid substitutions selected from the group consisting of: (i) S267K/L368D/K370S:S267K/S364K/E357Q; (ii) S364K/E357Q:L368D/K370S; (iii) L368D/K370S:S364K; (iv) L368E/K370S:S364K; (v) T411E/E360E/Q362E:D401K; (vi) L368D/K370S:S364K/E357Q, and (vii) K370S:S364K/E357Q, according to EU numbering.

In some embodiments, the first or said second Fc domains have an additional amino acid substitution comprising Q295E/N384D/Q418E/N421D, according to EU numbering.

In some embodiments, the first and said second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In some embodiments, the first and said second Fc domains have an additional set of amino acid substitutions M428L/N434S.

In some embodiments, provided is a nucleic acid composition comprising a nucleic acid sequence encoding any one of the first monomers described herein.

In some embodiments, provided is a nucleic acid composition comprising a nucleic acid sequence encoding any one of the second monomers described herein.

In some embodiments, provided is a expression vector composition comprising any of the nucleic acid compositions outlined herein.

In some embodiments, provided is a expression vector composition comprising one or more of any of the nucleic acid compositions outlined herein.

In some embodiments, provided is a host cell comprising any of the expression vector compositions outlined.

In some embodiments, provided is a method of producing a heterodimeric protein comprising culturing any one of the host cells under suitable conditions wherein said heterodimeric protein is expressed, and recovering said protein.

In some embodiments, provided is method of treating cancer in a patient in need thereof comprising administering a therapeutically effective amount of any of the targeted heterodimeric protein described herein to said patient.

In some aspects, the present invention provides a targeted heterodimeric protein comprising:
a) a first monomer comprising, from N- to C-terminal:
  i) a human IL-15Rα(sushi) domain;
  ii) a first domain linker; and
  iii) a first variant Fc domain;
b) a second monomer comprising, from N- to C-terminal:
  i) a NKG2D antigen binding domain (ABD);
  ii) an optional second domain linker;
  iii) a second variant Fc domain; and
c) a third monomer comprising a variant of human IL-15 comprising the amino acid sequence of SEQ ID NO:2 and one or more amino acid substitutions selected from the group consisting of N1D, N4D, D8N, D30N, D61N, E64Q, N65D, and Q108E.

In some embodiments, the NKG2D ABD comprises a variable heavy and light domain pair selected from the group consisting of MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]_H2L2, mAb D[NKG2D]_H1L1, and mAb E[NKG2D]_H1L1.

In some embodiments, the variant of human IL-15 protein has amino acid substitutions selected from the group consisting of N4D/N65D, D30N/N65D, D30N/E64Q/N65D, N1D, N4D, D8N, D30N, D61N, E64Q, N65D, Q108E, N1D/D61N, N1D/E64Q, N4D, D61N, N4D/E64Q, D8N/D61N, D8N/E64Q, D61N/E64Q, E64Q/Q108E, N1D/N4D/D8N, D61N/E64Q, N1D/D61N/E64Q/Q108E, N4D/D61N/E64Q/Q108E, N1D/N65Q, D30N/Q108E, N65D/Q108E, E64Q/N65D, N1D/N4D/N65D, and N4D/D61N/N65D.

In some embodiments, the said human IL-15Rα(sushi) domain comprises the amino acid sequence of SEQ ID NO:4.

In some embodiments, the NKG2D antigen binding domain is a single chain variable fragment (scFv) or a Fab fragment.

In some embodiments, the first Fc domain and said second Fc domain have a set of amino acid substitutions selected from the group consisting of: (i) S267K/L368D/K370S: S267K/S364K/E357Q; (ii) S364K/E357Q:L368D/K370S; (iii) L368D/K370S:S364K; (iv) L368E/K370S:S364K; (v) T411E/E360E/Q362E:D401K; (vi) L368D/K370S:S364K/E357Q, and (vii) K370S:S364K/E357Q, according to EU numbering.

In some embodiments, the first or said second Fc domains have an additional amino acid substitution comprising Q295E/N384D/Q418E/N421D, according to EU numbering.

In some embodiments, the first and said second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In some embodiments, the first and said second Fc domains have an additional set of amino acid substitutions M428L/N434S.

In some embodiments, provided is a nucleic acid composition comprising a nucleic acid sequence encoding any one of the first monomers described herein.

In some embodiments, provided is a nucleic acid composition comprising a nucleic acid sequence encoding any one of the second monomers described herein.

In some embodiments, provided is a nucleic acid composition comprising a nucleic acid sequence encoding any one of the third monomers described herein.

In some embodiments, provided is an expression vector composition comprising any of the nucleic acid compositions outlined herein.

In some embodiments, provided is an expression vector composition comprising one or more of any of the nucleic acid compositions outlined herein.

In some embodiments, provided is a host cell comprising any of the expression vector compositions outlined.

In some embodiments, provided is a method of producing a heterodimeric protein comprising culturing any one of the host cells under suitable conditions wherein said heterodimeric protein is expressed, and recovering said protein.

In some embodiments, provided is method of treating cancer in a patient in need thereof comprising administering a therapeutically effective amount of any of the targeted heterodimeric protein described herein to said patient.

In some aspects, the present invention provides a targeted heterodimeric protein comprising:
a) a first antibody fusion protein comprising a first NKG2D antigen binding domain and a first variant Fc domain, wherein said first NKG2D antigen binding domain is covalently attached to the N-terminus of said first Fc domain via a first domain linker, and said first NKG2D antigen binding domain is a single chain variable fragment (scFv) or a Fab fragment;
b) a second antibody fusion protein comprising a second NKG2D antigen binding domain, a second Fc domain, and a first protein domain, wherein said second NKG2D antigen binding domain is covalently attached to the N-terminus of said second Fc domain via a second domain linker, said first protein domain is covalently attached to the C-terminus of said second Fc domain via a third domain linker, said second NKG2D antigen binding domain is a single chain variable fragment (scFv) or a Fab fragment, and said first protein domain comprises a human IL-15Rα (sushi) domain; and c) a second protein domain noncovalently attached to said first protein domain of said second antibody fusion protein and comprising a variant of human IL-15 comprising the amino acid sequence of SEQ ID NO:2 and one or more amino acid substitutions selected from the group consisting of N1D, N4D, D8N, D30N, D61N, E64Q, N65D, and Q108E.

In some embodiments, the first and said second Fc domains have a set of amino acid substitutions selected from the group consisting of S267K/L368D/K370S:S267K/S364K/E357Q; S364K/E357Q:L368D/K370S; L368D/K370S:S364K; L368E/K370S:S364K; T411E/E360E/Q362E:D401K; L368D/K370S:S364K/E357L and K370S:S364K/E357Q, according to EU numbering.

In some embodiments, the variant of human IL-15 has amino acid substitutions selected from the group consisting of N4D/N65D, D30N/N65D, D30N/E64Q/N65D, N1D, N4D, D8N, D30N, D61N, E64Q, N65D, Q108E, N1D/D61N, N1D/E64Q, N4D, D61N, N4D/E64Q, D8N/D61N, D8N/E64Q, D61N/E64Q, E64Q/Q108E, N1D/N4D/D8N, D61N/E64Q/N65Q, N1D/D61N/E64Q/Q108E, N4D/D61N/E64Q/Q108E, N1D/N65D, D30N/Q108E, N65D/Q108E, E64Q/N65D, N1D/N4D/N65D, and N4D/D61N/N65D.

In some embodiments, the human IL-15Rα(sushi) domain comprises the amino acid sequence of SEQ ID NO:4.

In some embodiments, the NKG2D antigen binding domain comprises a variable heavy and light domain pair selected from the group consisting of MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7 [NKG2D]_H0L0, 11B2D10[NKG2D]H0L0, 16F31 [NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]_H2L2, mAb D[NKG2D]_H1L1, and mAb E[NKG2D]_H1L1.

In some embodiments, the first or said second Fc domains have an additional amino acid substitution comprising Q295E/N384D/Q418E/N421D, according to EU numbering.

In some embodiments, the first and said second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In some embodiments, the first and said second Fc domains have an additional set of amino acid substitutions M428L/N434S.

In some embodiments, provided is a nucleic acid composition comprising a nucleic acid sequence encoding any one of the first antibody fusion proteins described herein.

In some embodiments, provided is a nucleic acid composition comprising a nucleic acid sequence encoding any one of the second antibody fusion protein described herein.

In some embodiments, provided is a nucleic acid composition comprising a nucleic acid sequence encoding any one of the second protein domains described herein.

In some embodiments, provided is an expression vector composition comprising any of the nucleic acid compositions outlined herein.

In some embodiments, provided is an expression vector composition comprising one or more of any of the nucleic acid compositions outlined herein.

In some embodiments, provided is a host cell comprising any of the expression vector compositions outlined.

In some embodiments, provided is a method of producing a heterodimeric protein comprising culturing any one of the host cells under suitable conditions wherein said heterodimeric protein is expressed, and recovering said protein.

In some embodiments, provided is method of treating cancer in a patient in need thereof comprising administering a therapeutically effective amount of any of the targeted heterodimeric protein described herein to said patient.

In some aspects, the present invention provides a targeted heterodimeric protein selected from the group consisting of XENP27195, XENP27197, XENP27615, XENP27616, XENP27617, XENP27618, XENP27619, XENP27620, XENP27621, XENP27622, XENP27623, XENP27624, XENP27625, XENP27626, XENP27627, XENP27628, XENP27629, XENP27630, XENP27631, XENP27632, XENP27633, XENP27634, XENP27635, XENP27636, XENP27637, XENP27638, XENP30592, XENP31077, XENP30453, XENP30593, XENP30595, XENP31078, XENP31080, XENP30594, XENP30596, XENP31079, XENP31081, XENP33332, XENP33334, XENP33336, XENP33338, XENP33340, XENP33342, XENP33344, XENP33346, XENP33350, XENP33352, XENP33354, XENP33356, XENP33358, XENP33360, XENP33362, and XENP33364.

In some aspects, the present invention provides a pharmaceutical composition comprising a targeted heterodimeric protein selected from the group consisting of XENP27195, XENP27197, XENP27615, XENP27616, XENP27617, XENP27618, XENP27619, XENP27620, XENP27621, XENP27622, XENP27623, XENP27624, XENP27625, XENP27626, XENP27627, XENP27628, XENP27629, XENP27630, XENP27631, XENP27632, XENP27633, XENP27634, XENP27635, XENP27636, XENP27637, XENP27638, XENP30592, XENP31077, XENP30453, XENP30593, XENP30595, XENP31078, XENP31080, XENP30594, XENP30596, XENP31079, XENP31081, XENP33332, XENP33334, XENP33336, XENP33338, XENP33340, XENP33342, XENP33344, XENP33346, XENP33350, XENP33352, XENP33354, XENP33356, XENP33358, XENP33360, XENP33362, and XENP33364; and a pharmaceutically acceptable carrier.

In one aspect, provided is a method of treating a patient in need thereof comprising administering to the patient any one of the targeted heterodimeric proteins or any one of the pharmaceutical compositions thereof.

In some embodiments, the method further comprises administering a therapeutically effective amount of a checkpoint blockade antibody selected from the group consisting of an anti-PD-1 antibody, an anti-PD-L1 antibody, an anti-TIM3 antibody, an anti-TIGIT antibody, an anti-LAG3 antibody, and an anti-CTLA-4 antibody.

In some embodiments, the targeted heterodimeric protein or the pharmaceutical composition and the checkpoint blockade antibody are administered concomitantly or sequentially.

In some embodiments, the anti-PD-1 antibody is nivolumab, pembrolizumab, or pidilizumab.

Also provided is a host cell comprising any one of the nucleic acid composition described herein or a host cell comprising any one of the expression vector composition described herein.

In one aspect, the present invention provides a method or producing any of the targeted heterodimeric protein described herein. The method comprises (a) culturing the host cell described herein under suitable conditions wherein said targeted heterodimeric protein is expressed, and (b) recovering said protein.

In one aspect, the present invention provides a method of treating cancer in a patient in need thereof comprising administering a therapeutically effective amount of any one of the targeted heterodimeric proteins described herein or a pharmaceutical composition described herein to the patient.

Additional IL-15/IL-15Rα heterodimeric Fc fusion proteins are described in detail in, for example, in U.S. Ser. No. 62/684,143, filed Jun. 12, 2018, U.S. Ser. No. 62/659,563, filed Apr. 18, 2018, U.S. Ser. No. 62/408,655, filed Oct. 14, 2016, U.S. Ser. No. 62/416,087, filed Nov. 1, 2016, U.S. Ser. No. 62/443,465, filed Jan. 6, 2017, U.S. Ser. No. 62/477,926, filed Mar. 28, 2017, U.S. patent application Ser. No. 15/785,401, filed on Oct. 16, 2017, and PCT International Application No. PCT/US2017/056829, filed on Oct. 16, 2017, which are expressly incorporated by reference in their entirety, with particular reference to the figures, legends, sequence listing, and claims therein.

This application is related to International Application No. PCT/US2018/040653 filed Jul. 2, 2018, which claims priority to U.S. Provisional Application No. 62/527,898, filed Jun. 30, 2017, which is expressly incorporated herein by reference in its entirety, with particular reference to the figures, legends, sequence listing, and claims therein.

Other aspects of the invention are provided herein.

BRIEF DESCRIPTION OF THE DRAWINGS

FIG. 1A-FIG. 1E depict useful pairs of Fc heterodimerization variant sets (including skew and pI variants). There are variants for which there are no corresponding "monomer 2" variants; these are pI variants which can be used alone on either monomer.

FIG. 2 depicts a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein.)

FIG. 3 depicts useful ablation variants that ablate FcγR binding (sometimes referred to as "knock outs" or "KO" variants). Generally, ablation variants are found on both monomers, although in some cases they may be on only one monomer.

FIG. 4A-FIG. 4E show useful embodiments of "non-cytokine" components of the IL-15/Rα-Fc fusion proteins of the invention.

FIG. 5A-FIG. 5F show particularly useful embodiments of "non-cytokine"/"non-Fv" components of the CD8-targeted, NKG2A-targeted, and NKG2D-targeted IL-15/Rα-Fc fusion proteins of the invention.

FIG. 6 depicts a number of exemplary variable length linkers for use in IL-15/Rα-Fc fusion proteins. In some embodiments, these linkers find use linking the C-terminus of IL-15 and/or IL-15Rα(sushi) to the N-terminus of the Fc region. In some embodiments, these linkers find use fusing IL-15 to the IL-15Rα(sushi).

FIG. 7 depict a number of charged scFv linkers that find use in increasing or decreasing the pI of heterodimeric antibodies that utilize one or more scFv as a component. The (+H) positive linker finds particular use herein. A single prior art scFv linker with single charge is referenced as "Whitlow", from Whitlow et al., Protein Engineering 6(8): 989-995 (1993). It should be noted that this linker was used for reducing aggregation and enhancing proteolytic stability in scFvs.

FIG. 8A-FIG. 8D show the sequences of several useful IL-15/Rα-Fc format backbones based on human IgG1, without the cytokine sequences (e.g. the 11-15 and/or IL-15Rα (sushi)). It is important to note that these backbones can also find use in certain embodiments of CD8-targeted IL-15/Rα-Fc fusion proteins. Backbone 1 is based on human IgG1 (356E/358M allotype), and includes C220S on both chain, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes C220S on both chain, the S364K: L368D/K370S skew variants, the Q295E/N384D/Q418E/N421D pI variants on the chain with L368D/K370S skew variants and the E233P/L234V/L235A/G236del/S267K ablation variants on both chains. Backbone 3 is based on human IgG1 (356E/358M allotype), and includes C220S on both chain, the S364K:L368E/K370S skew variants, the Q295E/N384D/Q418E/N421D pI variants on the chain with L368E/K370S skew variants and the E233P/L234V/L235A/G236del/S267K ablation variants on both chains. Backbone 4 is based on human IgG1 (356E/358M allotype), and includes C220S on both chain, the D401K:K360E/Q362E/T411E skew variants, the Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes C220S on both chain, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 6 is based on human IgG1 (356E/358M allotype), and includes C220S on both chain, the S364K/E357Q:L368D/K370S skew variants, Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Alternative formats for backbones 6 and 7 can exclude the ablation variants E233P/L234V/L235A/G236del/S267K in both chains. Backbone 8 is based on human IgG4, and includes the S364K/E357Q:L368D/K370S skew variants, the Q295E/N384D/Q418E/N421D pI variants on the chain with L368D/K370S skew variants, as well as a S228P (EU numbering, this is S241P in Kabat) variant on both chains that ablates Fab arm exchange as is known in the art. Backbone 9 is based on human IgG2, and includes the S364K/E357Q:L368D/K370S skew variants, the Q295E/N384D/Q418E/N421D pI variants on the chain with L368D/K370S skew variants. Backbone 10 is based on human IgG2, and includes the S364K/E357Q:L368D/K370S skew variants, the Q295E/N384D/Q418E/N421D pI variants on the chain with L368D/K370S skew variants as well as a S267K variant on both chains. Backbone 11 is identical to backbone 1, except it includes M428L/N434S Xtend mutations. Backbone 12 is based on human IgG1 (356E/358M allotype), and includes C220S on both identical chain, the E233P/L234V/L235A/G236del/S267K ablation variants on both identical chains. Backbone 13 is based on human IgG1 (356E/358M allotype), and includes C220S on both chain, the S364K/E357Q:L368D/K370S skew variants, the P217R/P229R/N276K pI variants on the chain with S364K/E357Q skew variants and the E233P/L234V/L235A/G236del/S267K ablation variants on both chains.

Figure 14:
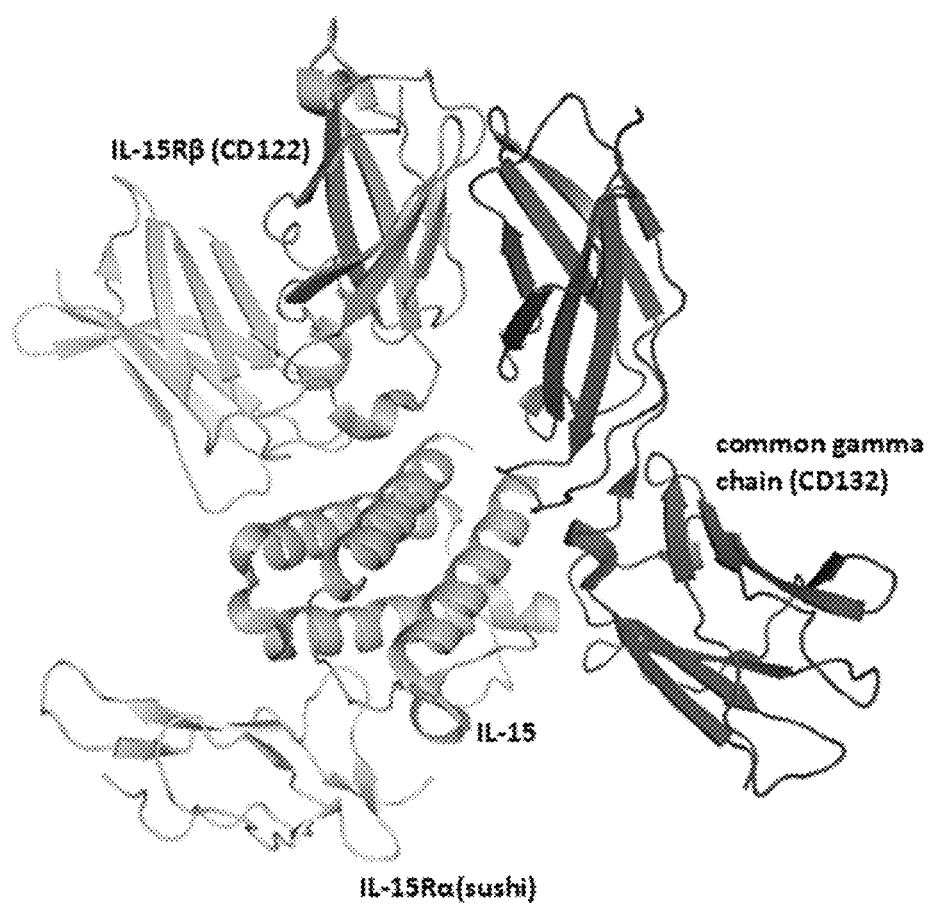

As will be appreciated by those in the art and outlined below, these sequences can be used with any IL-15 and IL-15Rα(sushi) pairs outlined herein, including but not limited to IL-15/Rα-heteroFc, ncIL-15/Rα, and scIL-15/Rα, as schematically depicted in FIGS. 16A-16G and 30A-30D. Additionally, any IL-15 and/or IL-15Rα(sushi) variants can be incorporated into these FIGS. 8A-8D backbones in any combination.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 9 shows the sequences of several useful CD8-targeted IL-15/Rα-Fc fusion format backbones based on human IgG1, without the cytokine sequences (e.g. the 11-15 and/or IL-15Rα(sushi)) or VH, and further excluding light chain backbones which are depicted in FIG. 10. Backbone 1 is based on human IgG1 (356E/358M allotype), and includes the S364K/E357Q:L368D/K370S skew variants, C220S and the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes the S364K/E357Q: L368D/K370S skew variants, the N208D/Q295E/N384D/Q418E/N421D pI variants on the chain with L368D/K370S skew variants, C220S in the chain with S364K/E357Q variants, and the E233P/L234V/L235A/G236del/S267K ablation variants on both chains. Backbone 3 is based on human IgG1 (356E/358M allotype), and includes the S364K/E357Q:L368D/K370S skew variants, the N208D/Q295E/N384D/Q418E/N421D pI variants on the chains with L368D/K370S skew variants, the Q196K/I199T/P217R/P228R/N276K pI variants on the chains with S364K/E357Q variants, and the E233P/L234V/L235A/G236del/S267K ablation variants on both chains.

In certain embodiments, these sequences can be of the 356D/358L allotype. In other embodiments, these sequences can include either the N297A or N297S substitutions. In some other embodiments, these sequences can include the M428L/N434S Xtend mutations. In yet other embodiments, these sequences can instead be based on human IgG4, and include a S228P (EU numbering, this is S241P in Kabat) variant on both chains that ablates Fab arm exchange as is known in the art. In yet further embodiments, these sequences can instead be based on human IgG2. Further, these sequences may instead utilize the other skew variants, pI variants, and ablation variants depicted in FIGS. 1A-1E, 2, and 3.

As will be appreciated by those in the art and outlined below, these sequences can be used with any IL-15 and IL-15Rα(sushi) pairs outlined herein, including but not limited to scIL-15/Rα, ncIL-15/Rα, and dsIL-15Rα, as schematically depicted in FIG. 70. Further as will be appreciated by those in the art and outlined below, any IL-15 and/or IL-15Rα(sushi) variants can be incorporated in these backbones. Furthermore, as will be appreciated by those in the art and outlined below, these sequences can be used with any VH and VL pairs outlined herein, including either a scFv or a Fab.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure. It should also be noted that the backbones depicted herein are also suitable for use in the NKG2A-targeted and NKG2D-targeted IL-15/Rα-Fc fusion proteins of the invention.

FIG. 10 depicts the "non-Fv" backbone of light chains (i.e. constant light chain) which find use in CD8-targeted, NKG2A-targeted, and NKG2D-targeted IL-15/Rα-Fc fusion proteins of the invention.

FIG. 11 depicts the sequences for XENP15074, an anti-RSV mAb based on the variable regions of motavizumab (Numax®), which is a control used in a number of examples described herein. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 12 depicts the sequences for XENP16432, an anti-PD-1 mAb based on the variable regions of nivolumab (Opdivo®). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 13 depicts the sequences for XENP26007, an "RSV-targeted" IL-15/Rα-Fc fusion used as control in many of the examples described herein. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

FIG. 14 depicts the structure of IL-15 in complex with its receptors IL-15Rα (CD215), IL-15Rβ (CD122), and the common gamma chain (CD132).

FIG. 15A-FIG. 15B depict the sequences for IL-15 and its receptors.

FIG. 16A-FIG. 16G depict several formats for the IL-15/Rα-Fc fusion proteins of the present invention. IL-15Rα Heterodimeric Fc fusion or "IL-15/Rα-heteroFc" (FIG. 16A) comprises IL-15 recombinantly fused to one side of a heterodimeric Fc and IL-15Rα(sushi) recombinantly fused to the other side of a heterodimeric Fc. The IL-15 and IL-15Rα(sushi) may have a variable length Gly-Ser linker between the C-terminus and the N-terminus of the Fc region. Single-chain IL-15/Rα-Fc fusion or "scIL-15/Rα-Fc" (FIG. 16B) comprises IL-15Rα(sushi) fused to IL-15 by a variable length linker (termed a "single-chain" IL-15/IL-15Rα(sushi) complex or "scIL-15/Rα") which is then fused to the N-terminus of a heterodimeric Fc-region, with the other side of the molecule being "Fc-only" or "empty Fc". Non-covalent IL-15/Rα-Fc or "ncIL-15/Rα-Fc" (FIG. 16C) comprises IL-15Rα(sushi) fused to a heterodimeric Fc region, while IL-15 is transfected separately so that a non-covalent IL-15/Rα complex is formed, with the other side of the molecule being "Fc-only" or "empty Fc". Bivalent non-covalent IL-15/Rα-Fc fusion or "bivalent ncIL-15/Rα-Fc" (FIG. 16D) comprises IL-15Rα(sushi) fused to the N-terminus of a homodimeric Fc region, while IL-15 is transfected separately so that a non-covalent IL-15/Rα complex is formed. Bivalent single-chain IL-15/Rα-Fc fusion or "bivalent scIL-15/Rα-Fc" (FIG. 16E) comprises IL-15 fused to IL-15Rα(sushi) by a variable length linker (termed a "single-chain" IL-15/IL-15Rα(sushi) complex or "scIL-15/Rα") which is then fused to the N-terminus of a homodimeric Fc-region. Fc-non-covalent IL-15/Rα fusion or "Fc-ncIL-15/Rα" (FIG. 16F) comprises IL-15Rα(sushi) fused to the C-terminus of a heterodimeric Fc region, while IL-15 is transfected separately so that a non-covalent IL-15/Rα complex is formed, with the other side of the molecule being "Fc-only" or "empty Fc". Fc-single-chain IL-15/Rα fusion or "Fc-scIL-15/Rα" (FIG. 16G) comprises IL-15 fused to IL-15Rα(sushi) by a variable length linker (termed a "single-chain" IL-15/IL-15Rα(sushi) complex or "scIL-15/Rα") which is then fused to the C-terminus of a heterodimeric Fc region, with the other side of the molecule being "Fc-only" or "empty Fc".

FIG. 17 depicts sequences of XENP20818 and XENP21475, illustrative IL-15/Rα-Fc fusion proteins of the "IL-15/Rα-heteroFc" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 18 depicts sequences of XENP21478 and XENP21993, illustrative IL-15/Rα-Fc fusion protein of the "scIL-15/Rα-Fc" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 19A-FIG. 19B depict sequences of XENP21479, XENP22366 and XENP24348, illustrative IL-15/Rα-Fc fusion proteins of the "ncIL-15/Rα-Fc" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 20 depicts sequences of XENP21978, an illustrative IL-15/Rα-Fc fusion protein of the "bivalent ncIL-15/Rα-Fc" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 21 depicts sequences of an illustrative IL-15/Rα-Fc fusion protein of the "bivalent scIL-15/Rα-Fc" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 22 depicts sequences of XENP22637 and XENP22638, illustrative IL-15/Rα-Fc fusion proteins of the "Fc-ncIL-15/Rα" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

FIG. 23 depicts sequences of an illustrative IL-15/Rα-Fc fusion protein of the "Fc-scIL-15/Rα" format. IL-15 and IL-15Rα(sushi) are underlined, linkers are double underlined (although as will be appreciated by those in the art, the linkers can be replaced by other linkers, some of which are depicted in FIG. 6), and slashes (/) indicate the border(s) between IL-15, IL-15Rα, linkers, and Fc regions.

Figure 24A:
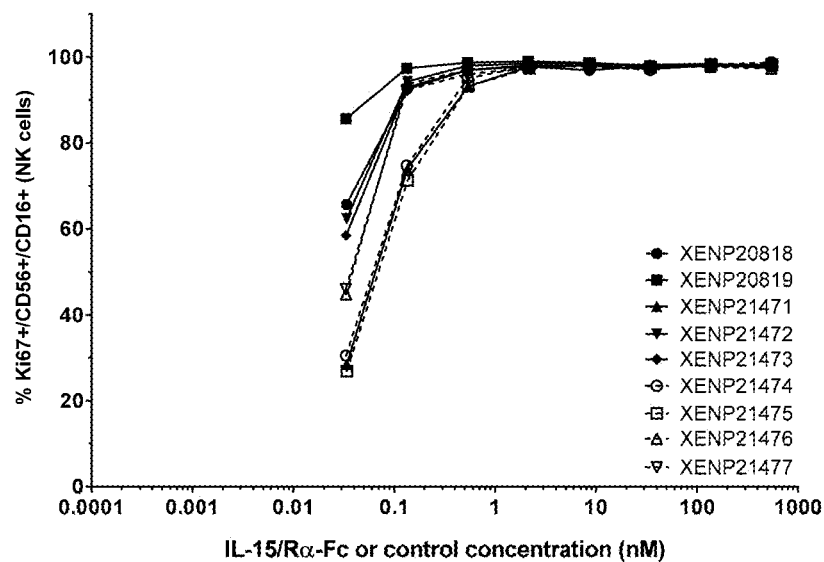
Figure 24B:
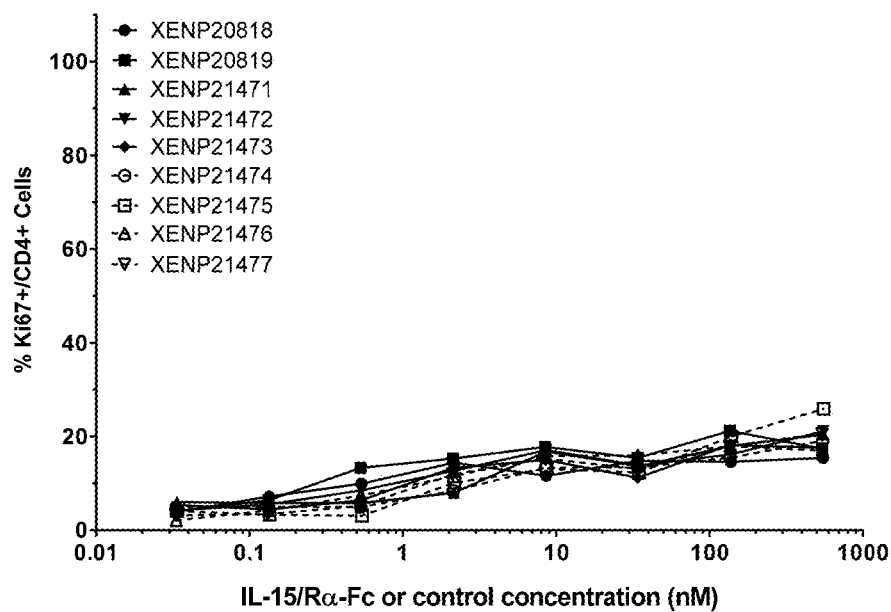
Figure 24C:
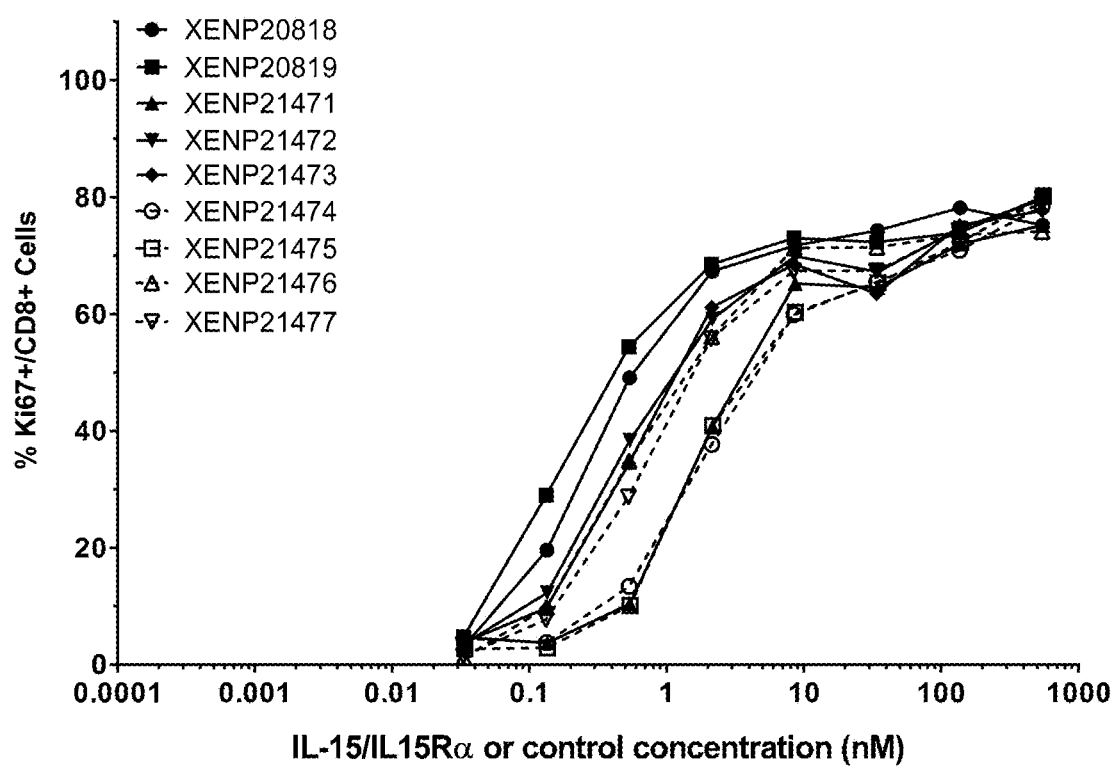

FIG. 24A-FIG. 24C depict the induction of (FIG. 24A) NK (CD56+/CD16+) cells, (FIG. 24B) CD4+ T cells, and (FIG. 24C CD8+ T cells proliferation by illustrative IL-15/Rα-Fc fusion proteins of Format A with different linker lengths based on Ki67 expression as measured by FACS.

Figure 25A:
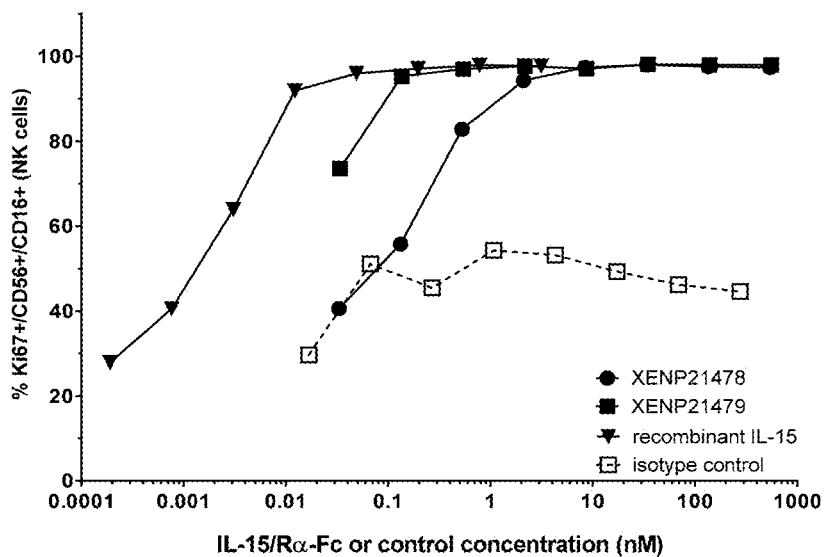
Figure 25B:
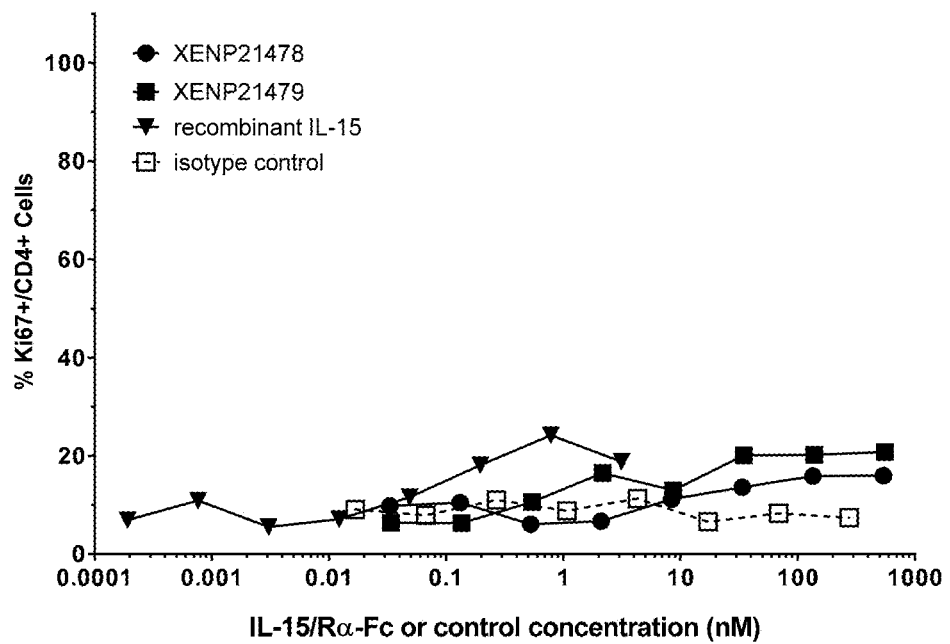
Figure 25C:
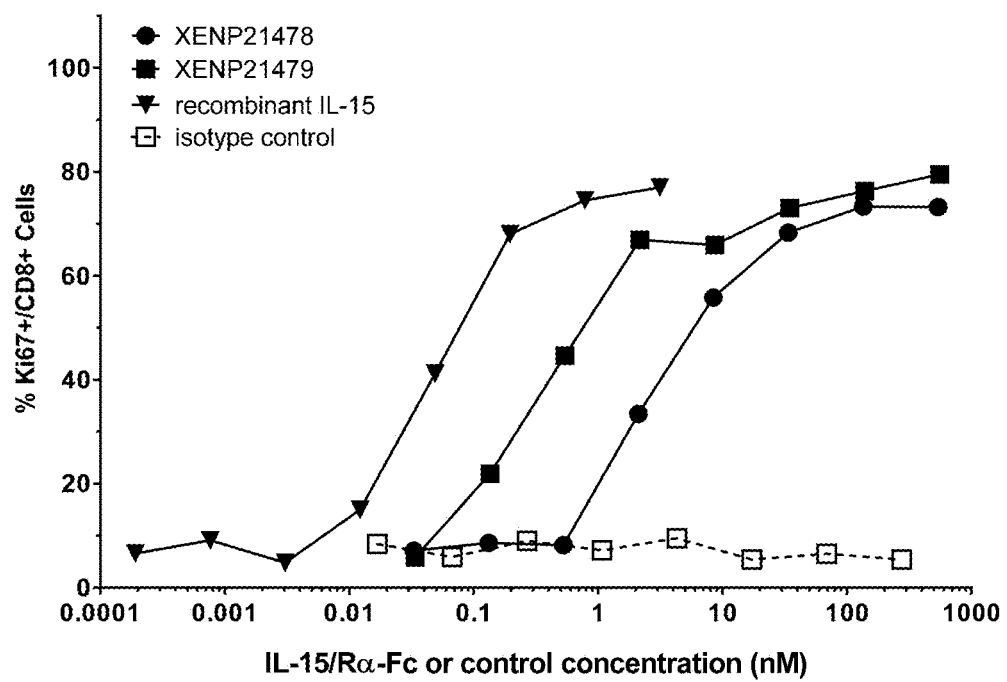

FIG. 25A-FIG. 25C depict the induction of (FIG. 25A) NK (CD56+/CD16+) cells, (FIG. 25B) CD4+ T cells, and (FIG. 25C) CD8+ T cells proliferation by illustrative IL-15/Rα-Fc fusion proteins of scIL-15/Rα-Fc format (XENP21478) and ncIL-15/Rα-Fc format (XENP21479) based on Ki67 expression as measured by FACS.

Figure 26:
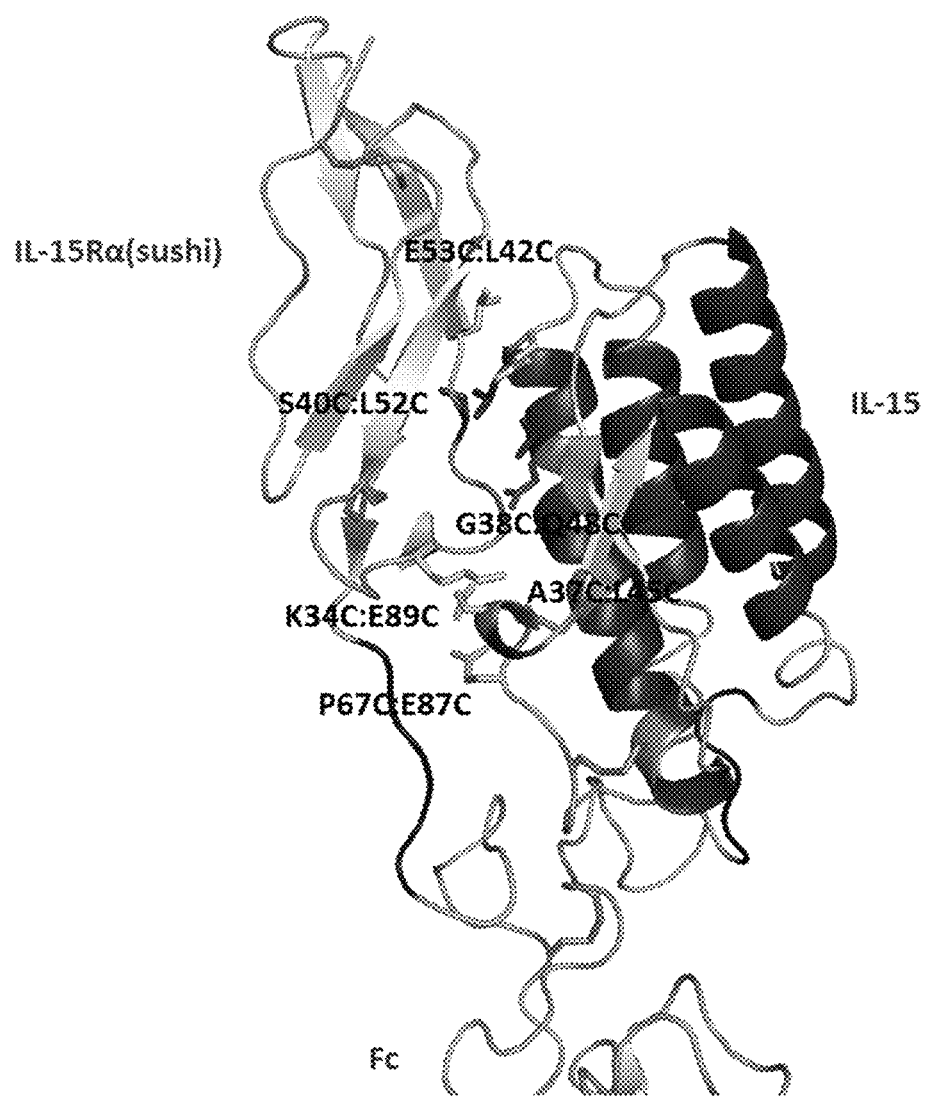

FIG. 26 depicts a structural model of the IL-15/Rα heterodimer showing locations of engineered disulfide bond pairs.

FIG. 27 depicts sequences for illustrative IL-15Rα(sushi) variants engineered with additional residues at the C-terminus to serve as a scaffold for engineering cysteine residues.

FIG. 28 depicts sequences for illustrative IL-15 variants engineered with cysteines in order to form covalent disulfide bonds with IL-15Rα(sushi) variants engineered with cysteines.

FIG. 29 depicts sequences for illustrative IL-15Rα(sushi) variants engineered with cysteines in order to form covalent disulfide bonds with IL-15 variants engineered with cysteines.

FIG. 30A-FIG. 30D depict additional formats for the IL-15/Rα-Fc fusion proteins of the present invention with engineered disulfide bonds. Disulfide-bonded IL-15/Rα heterodimeric Fc fusion or "dsIL-15/Rα-heteroFc" (FIG. 30A)

is the same as "IL-15/Rα-heteroFc", but wherein IL-15Rα (sushi) and IL-15 are further covalently linked as a result of engineered cysteines. Disulfide-bonded IL-15/Rα Fc fusion or "dsIL-15/Rα-Fc" (FIG. 30B) is the same as "ncIL-15/Rα-Fc", but wherein IL-15Rα(sushi) and IL-15 are further covalently linked as a result of engineered cysteines. Bivalent disulfide-bonded IL-15/Rα-Fc or "bivalent dsIL-15/Rα-Fc" (FIG. 30C) is the same as "bivalent ncIL-15/Rα-Fc", but wherein IL-15Rα(sushi) and IL-15 are further covalently linked as a result of engineered cysteines. Fc-disulfide-bonded IL-15/Rα fusion or "Fc-dsIL-15/Rα" (FIG. 30D) is the same as "Fc-ncIL-15/Rα", but wherein IL-15Rα(sushi) and IL-15 are further covalently linked as a result of engineered cysteines.

FIG. 31A-FIG. 31B depict sequences of XENP22013, XENP22014, XENP22015, and XENP22017, illustrative IL-15/Rα-Fc fusion protein of the "dsIL-15/Rα-heteroFc" format. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 32A-FIG. 32B depict sequences of XENP22357, XENP22358, XENP22359, XENP22684, and XENP22361, illustrative IL-15/Rα-Fc fusion proteins of the "dsIL-15/Rα-Fc" format. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 33 depicts sequences of XENP22634, XENP22635, XENP22636 and XENP22687, illustrative IL-15/Rα-Fc fusion proteins of the "bivalent dsIL-15/Rα-Fc" format. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 34 depicts sequences of XENP22639 and XENP22640, illustrative IL-15/Rα-Fc fusion proteins of the "Fc-dsIL-15/Rα" format. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

Figure 35:
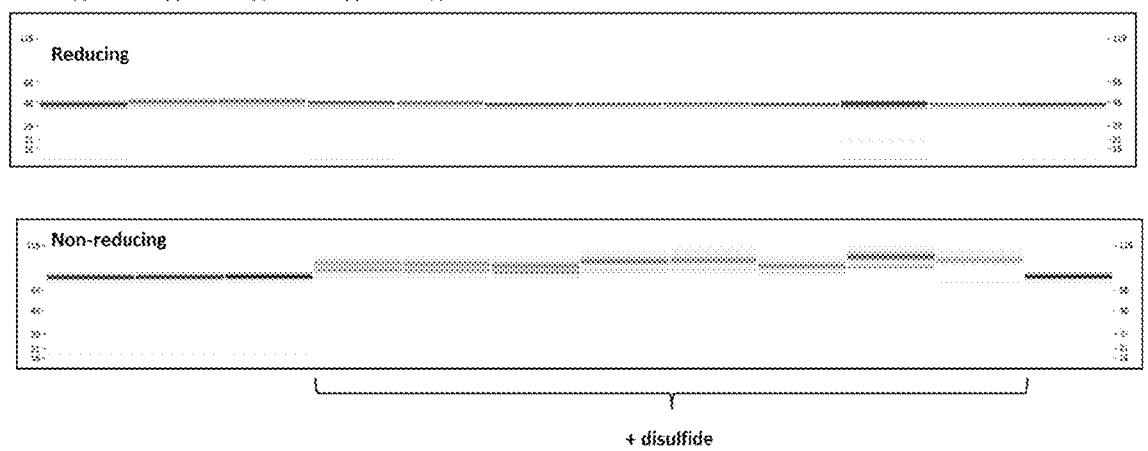

FIG. 35 depicts the purity and homogeneity of illustrative IL-15/Rα-Fc fusion proteins with and without engineered disulfide bonds as determined by CEF.

Figure 36A:
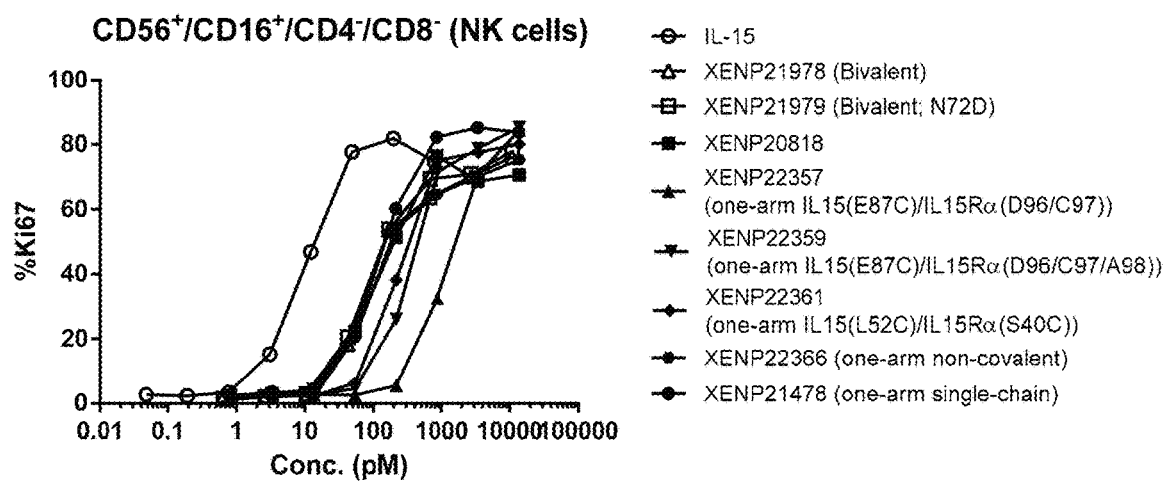
Figure 36B:
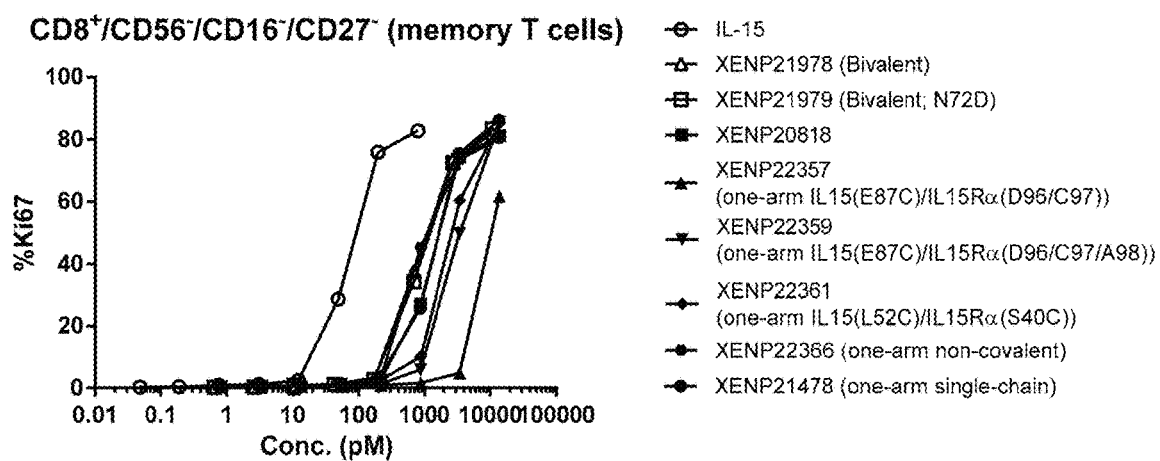
Figure 36C:
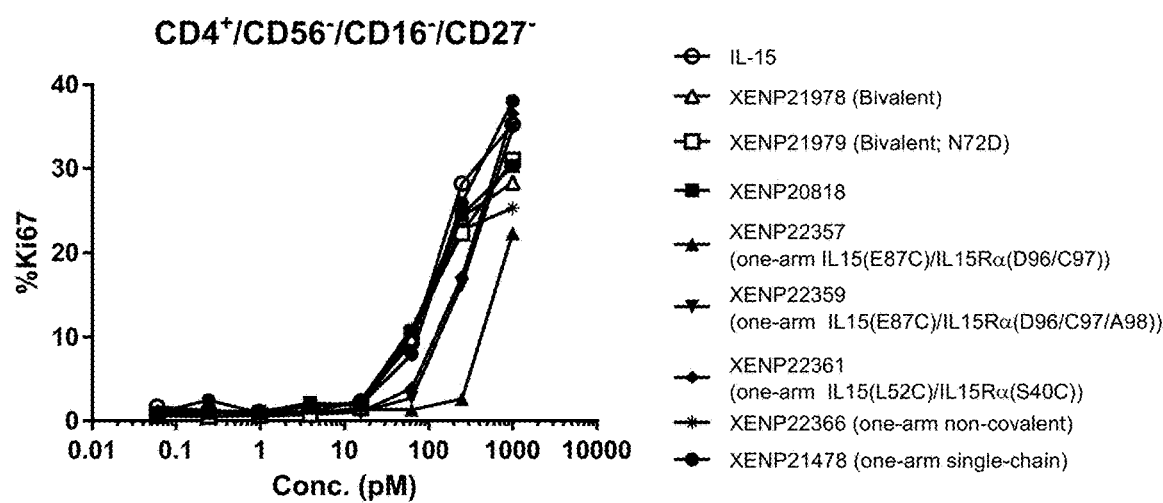

FIG. 36A-FIG. 36C depict the induction of (FIG. 36A) NK (CD56+/CD16+) cell, (FIG. 36B) CD8+ T cell, and (FIG. 36C) CD4+ T cell proliferation by illustrative IL-15/Rα-Fc fusion proteins with and without engineered disulfide bonds based on Ki67 expression as measured by FACS.

Figure 37:
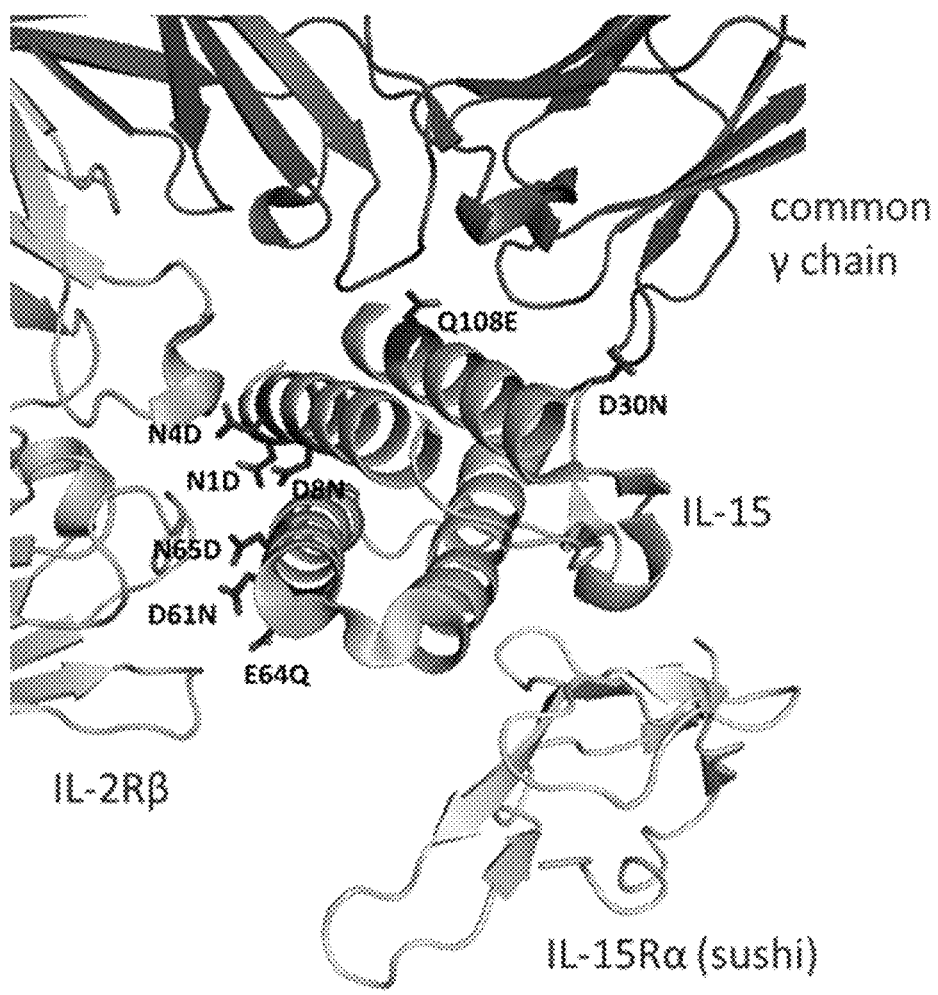

FIG. 37 depicts the structure of IL-15 complexed with IL-15Rα, IL-2Rβ, and common gamma chain. Locations of substitutions designed to reduce potency are shown.

FIG. 38A-FIG. 38C depict sequences for illustrative IL-15 variants engineered for reduced potency. Included within each of these variant IL-15 sequences are sequences that are 90, 95, 98 and 99% identical (as defined herein) to the recited sequences, and/or contain from 1, 2, 3, 4, 5, 6, 7, 8, 9 or 10 additional amino acid substitutions. In a non-limiting example, the recited sequences may contain additional amino acid modifications such as those contributing to formation of covalent disulfide bonds as described in Example 3B.

FIG. 39A-FIG. 39E depict sequences of XENP22821, XENP22822, XENP23343, XENP23554, XENP23557, XENP23561, XENP24018, XENP24019, XENP24045, XENP24051, XENP24052, and XENP24306, illustrative IL-15/Rα-Fc fusion proteins of the "IL-15/Rα-heteroFc" format engineered for reduced potency. IL-15 and IL-15Rα (sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 40A-FIG. 40D depict sequences of XENP24013, XENP24014, XENP24015, XENP24050, XENP24294, XENP24475, XENP24476, XENP24478, XENP24479, and XENP24481, illustrative IL-15/Rα-Fc fusion proteins of the "scIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 41A-FIG. 41B depict sequences of XENP24349, XENP24890, and XENP25138, illustrative IL-15/Rα-Fc fusion proteins of the "ncIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 42 depicts sequences of XENP22801 and XENP22802, illustrative ncIL-15/Rα heterodimers engineered for reduced potency. It is important to note that these sequences were generated using polyhistidine (Hisx6 or HHHHHH (SEQ ID NO: 5))C-terminal tags at the C-terminus of IL-15Rα(sushi).

FIG. 43 depicts sequences of XENP24342, an illustrative IL-15/Rα-Fc fusion protein of the "bivalent ncIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

FIG. 44 depicts sequences of XENP23472 and XENP23473, illustrative IL-15/Rα-Fc fusion proteins of the "dsIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 83), and slashes (/) indicate the border(s) between IL-15, IL-15Rα, linkers, and Fc regions.

Figure 45A:
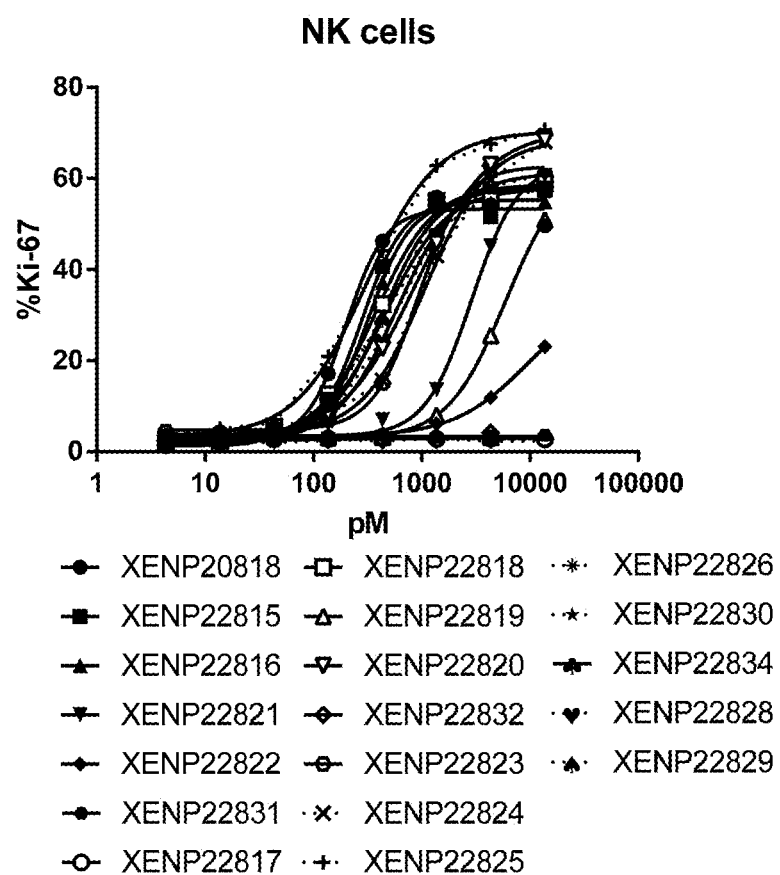
Figure 45B:
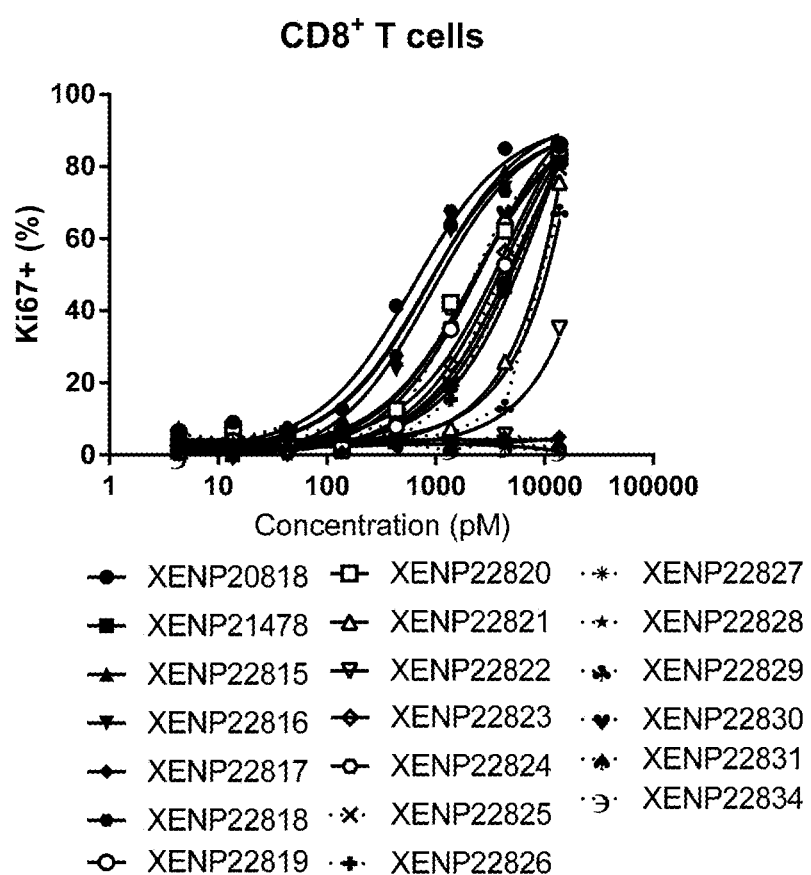
Figure 45C:
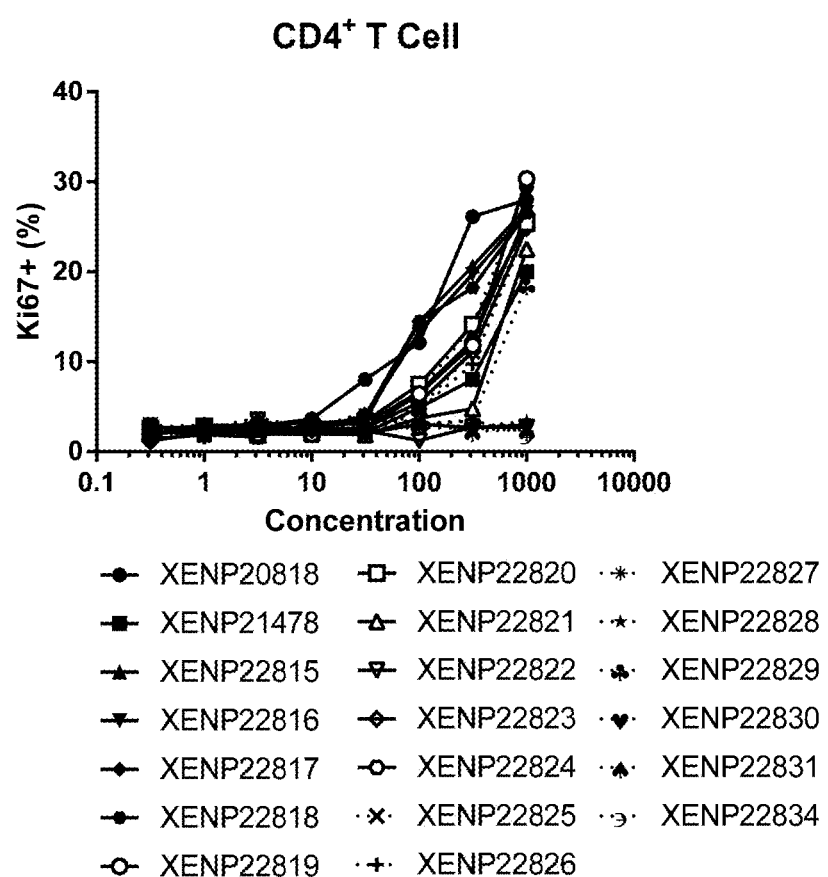

FIG. 45A-FIG. 45C depict the induction of A) NK cell, B) CD8+ (CD45RA−) T cell, and C) CD4+ (CD45RA−) T cell proliferation by variant IL-15/Rα-Fc fusion proteins based on Ki67 expression as measured by FACS.

FIG. 46 depicts EC50 for induction of NK and CD8+ T cells proliferation by variant IL-15/Rα-Fc fusion proteins, and fold reduction in EC50 relative to XENP20818.

Figure 47A:
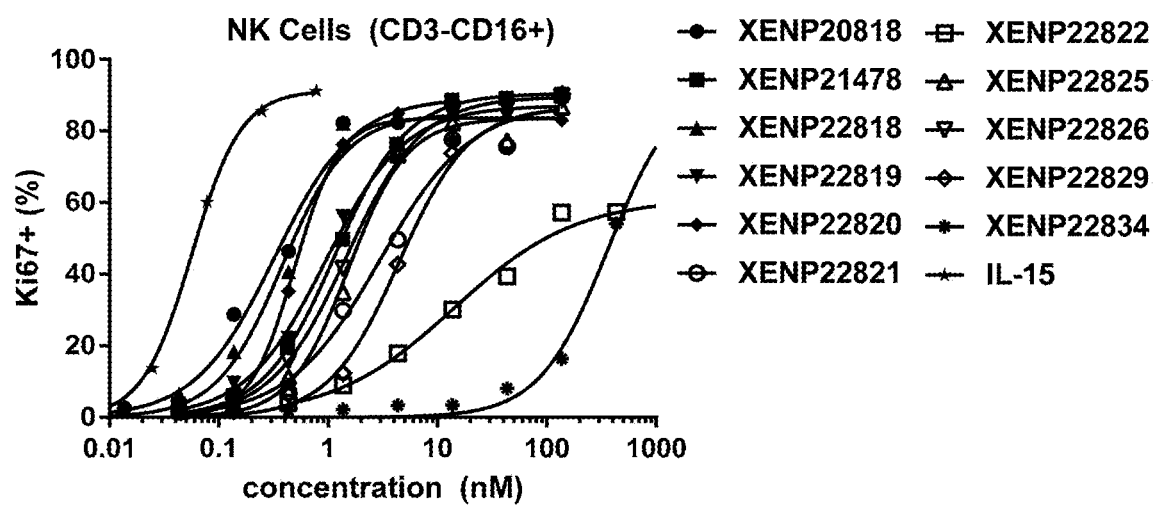
Figure 47B:
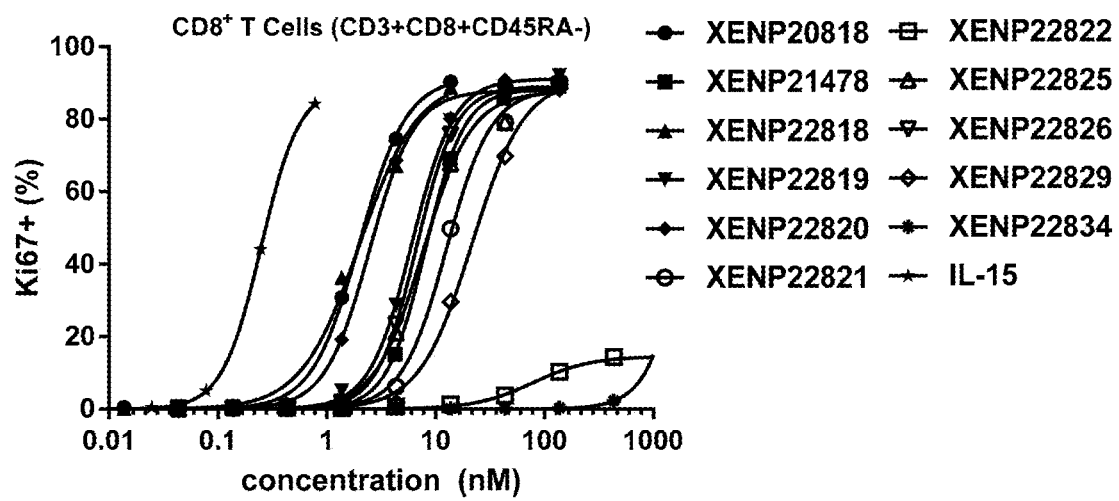
Figures 47C, 47D:
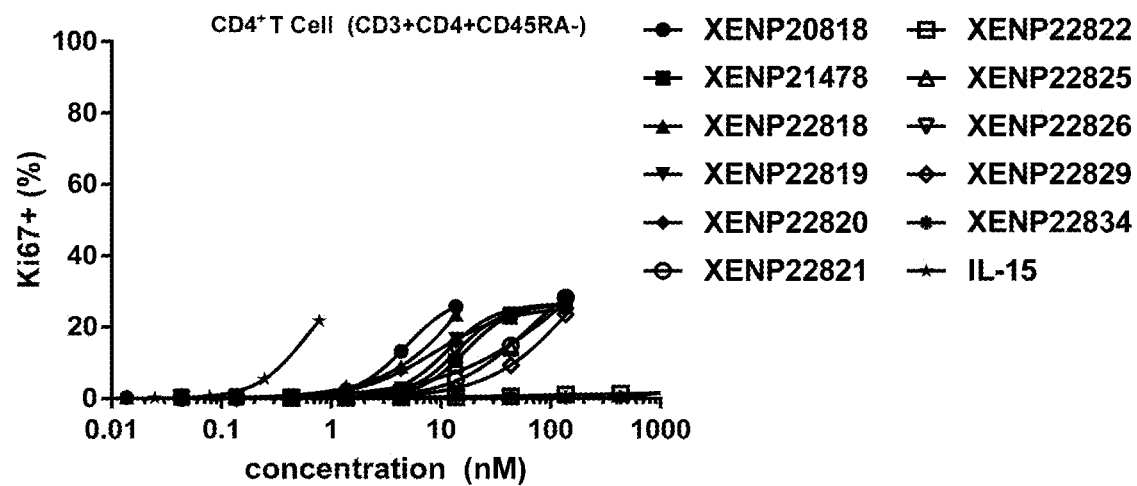

FIG. 47A-FIG. 47D depict cell proliferation in human PBMCs incubated for four days with the indicated variant IL-15/Rα-Fc fusion proteins. FIG. 47A-FIG. 47C show the percentage of proliferating NK cells (CD3−CD16+) (FIG. 47A), CD8+ T cells (CD3+CD8+CD45RA−) (FIG. 47B)

and CD4+ T cells (CD3+CD4+CD45RA−) (FIG. 47C). FIG. 47D shows the fold change in EC50 of various IL15/IL15Rα Fc heterodimers relative to control (XENP20818).

FIG. 48A-FIG. 48B depict CD69 and CD25 expression before (FIG. 48A) and after (FIG. 48B) incubation of human PBMCs with XENP22821.

Figure 49A:
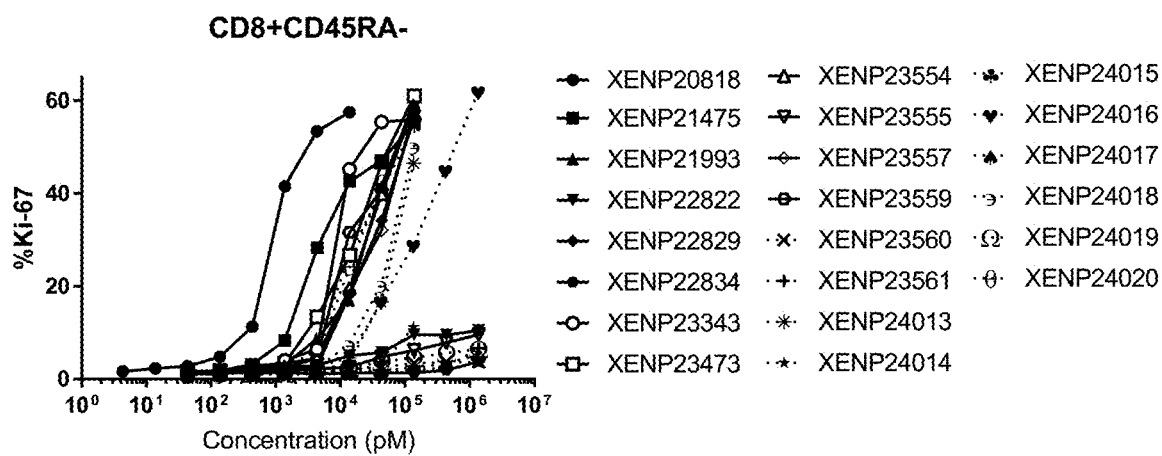
Figure 49B:
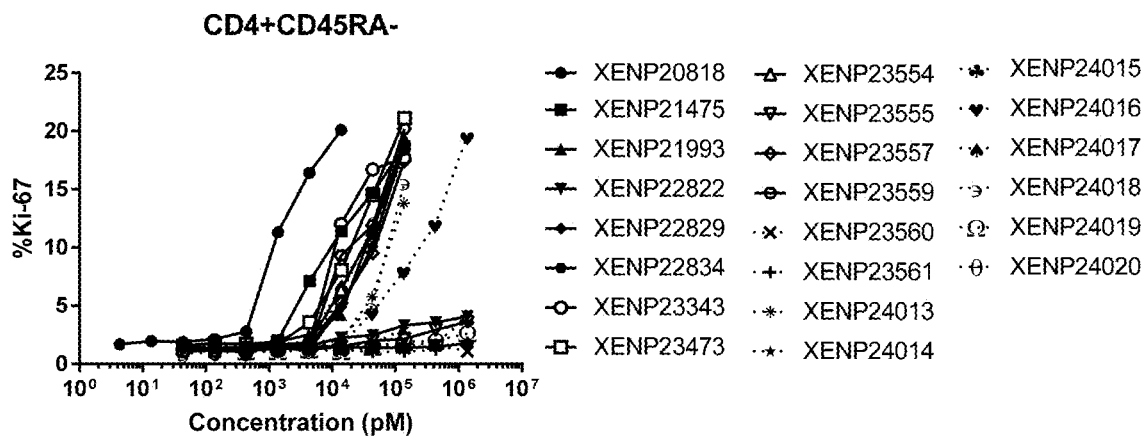
Figure 49C:
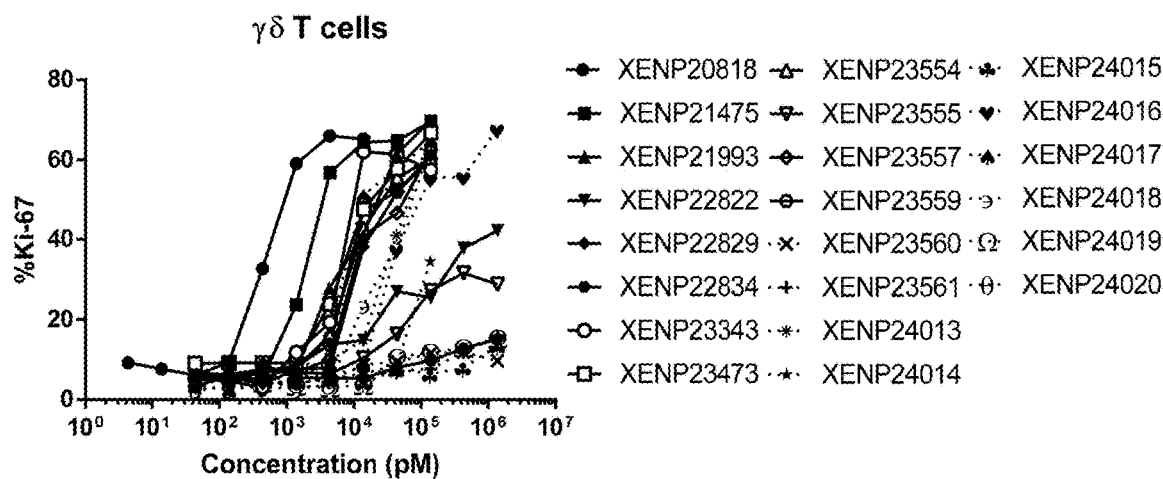
Figure 49D:
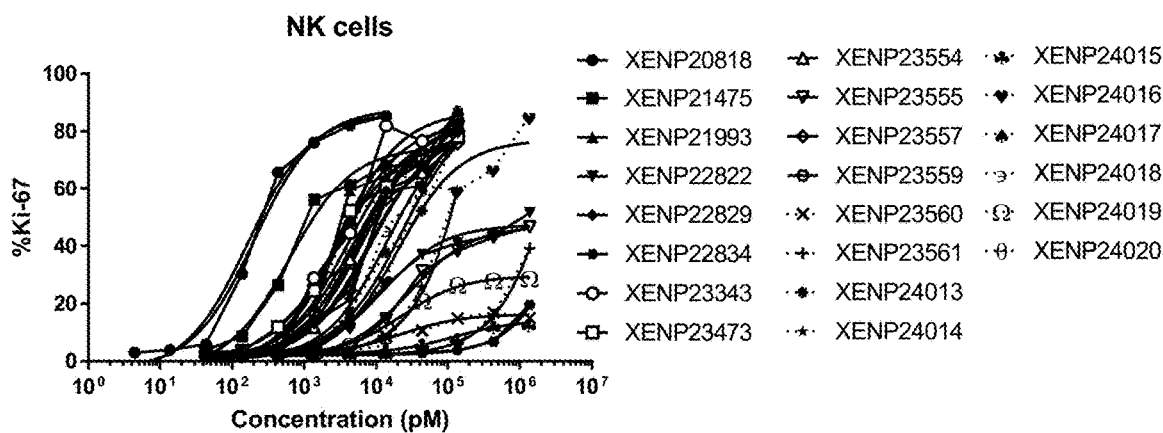
Figure 54A:
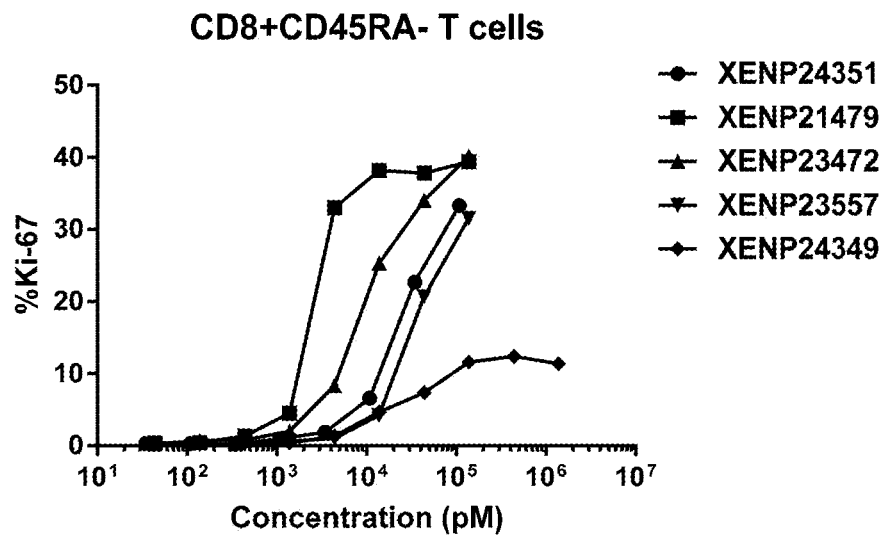
Figure 54B:
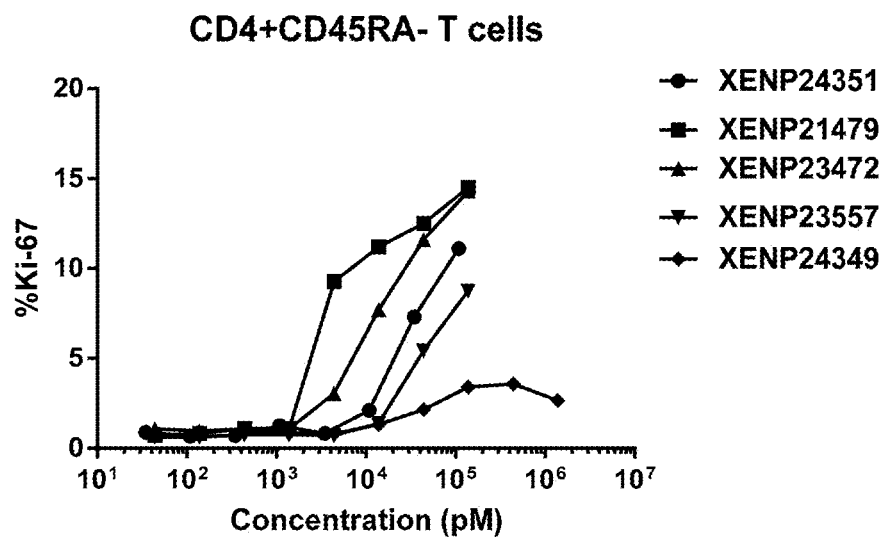
Figure 54C:
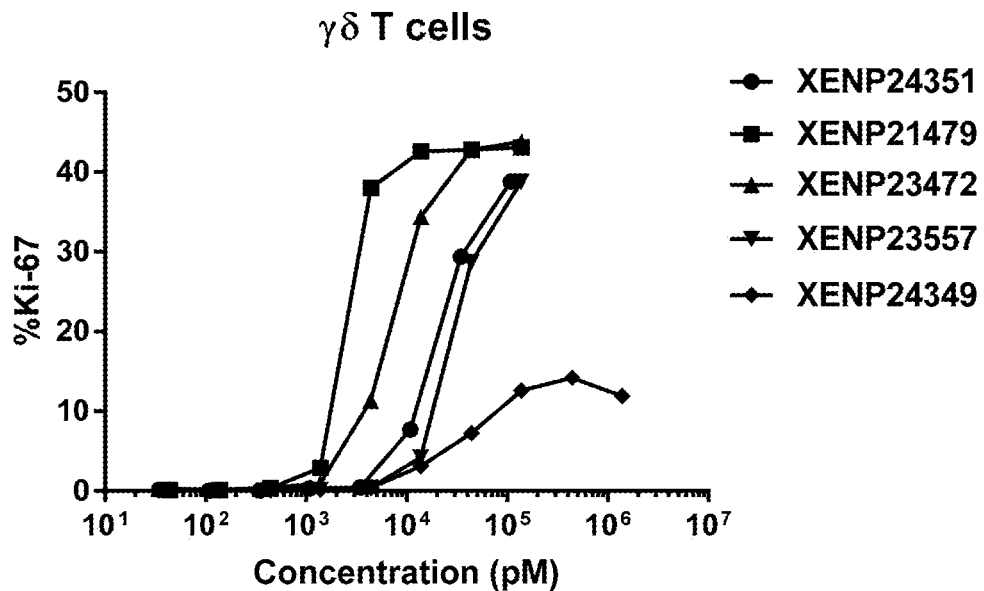
Figure 54D:
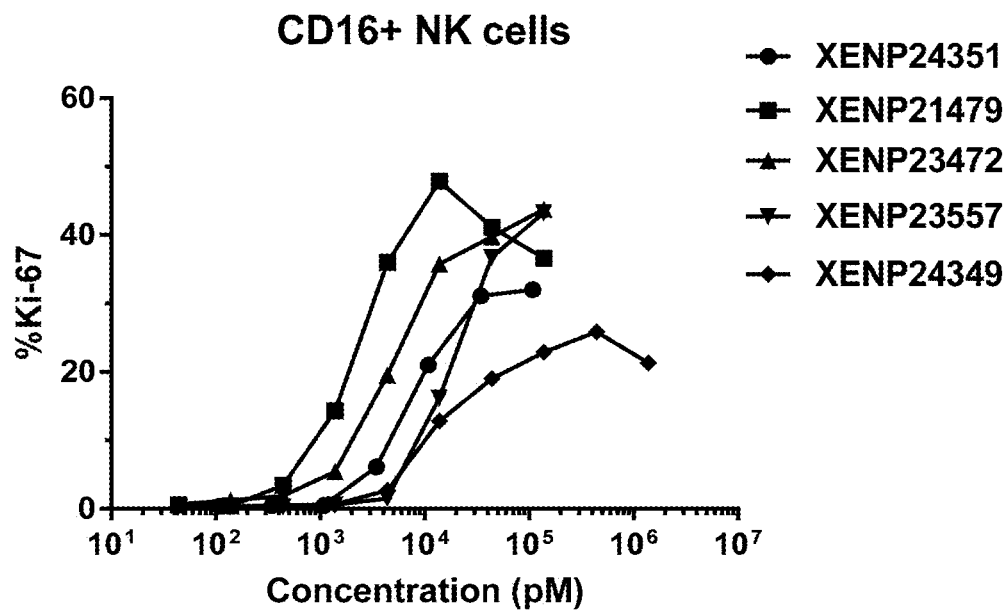

FIG. 49A-FIG. 49D depict cell proliferation in human PBMCs incubated for three days with the indicated variant IL-15/Rα-Fc fusion proteins. FIGS. 54A-C show the percentage of proliferating CD8+(CD45RA−) T cells (FIG. 49A), CD4+(CD45RA−) T cells (FIG. 49B), γδ T cells (FIG. 49C), and NK cells (FIG. 49D).

Figure 50A:
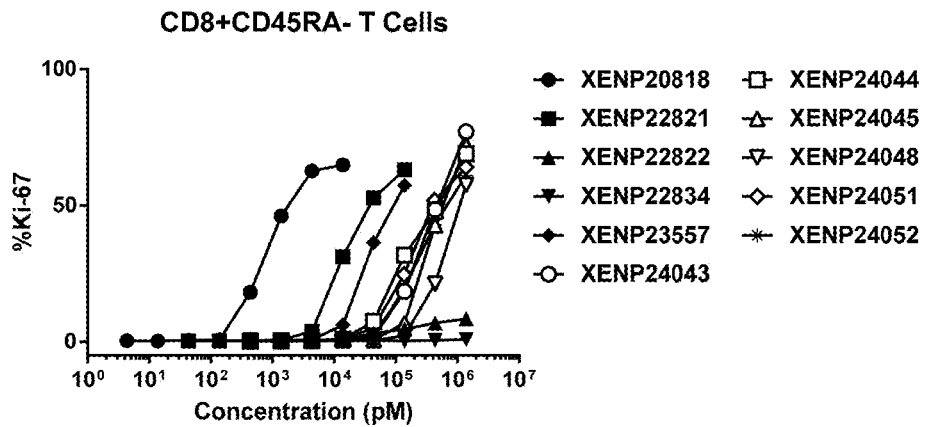
Figure 50B:
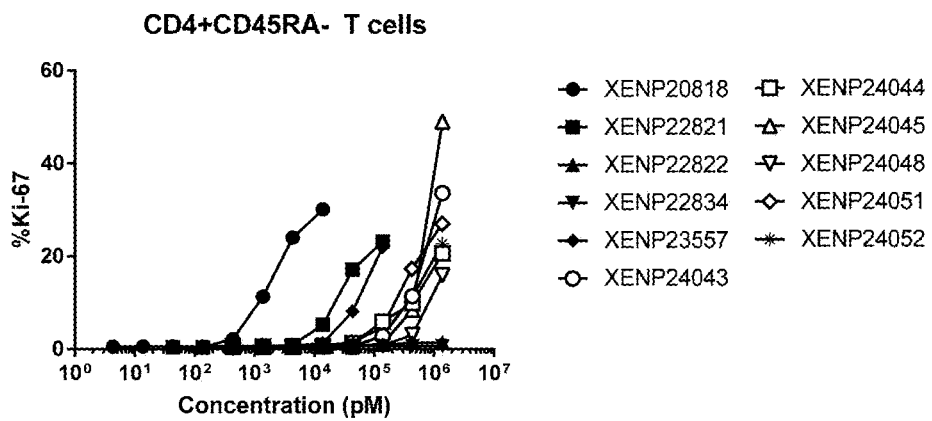
Figure 50C:
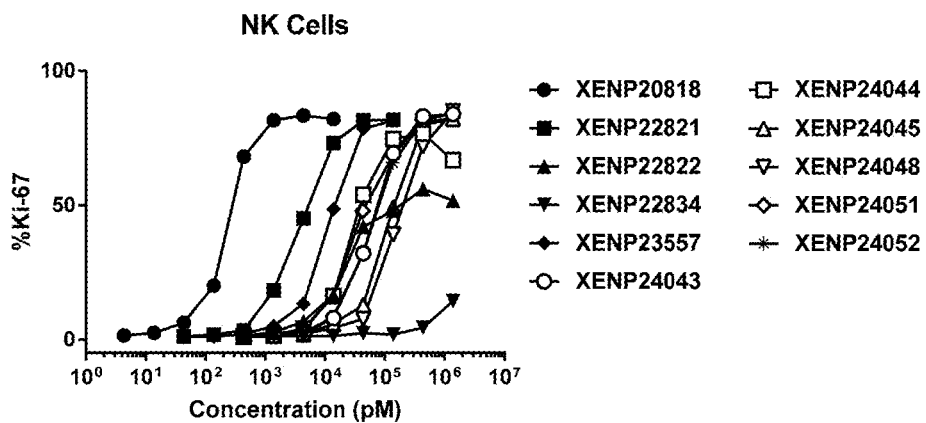
Figure 51A:
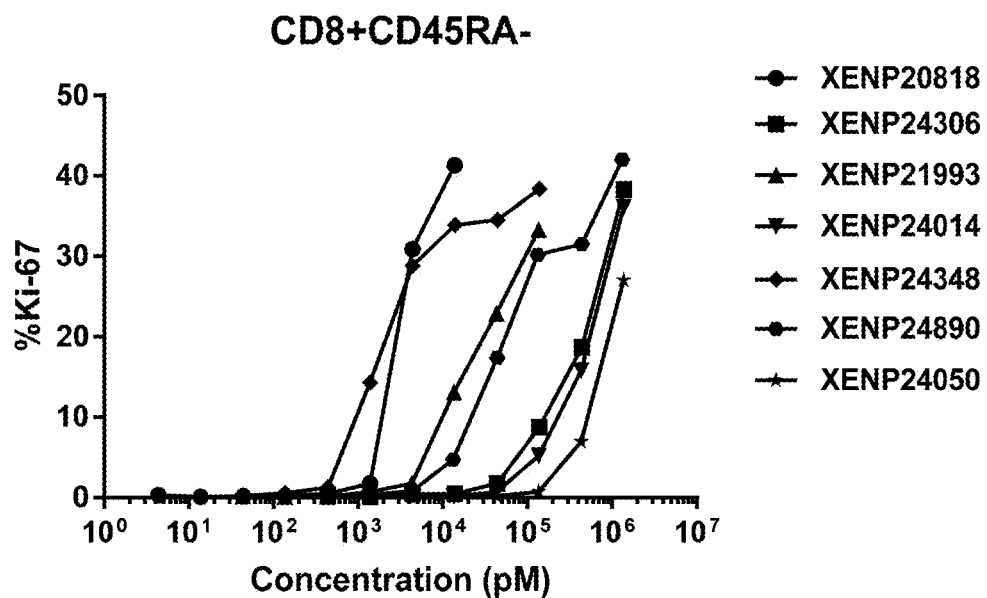
Figure 51B:
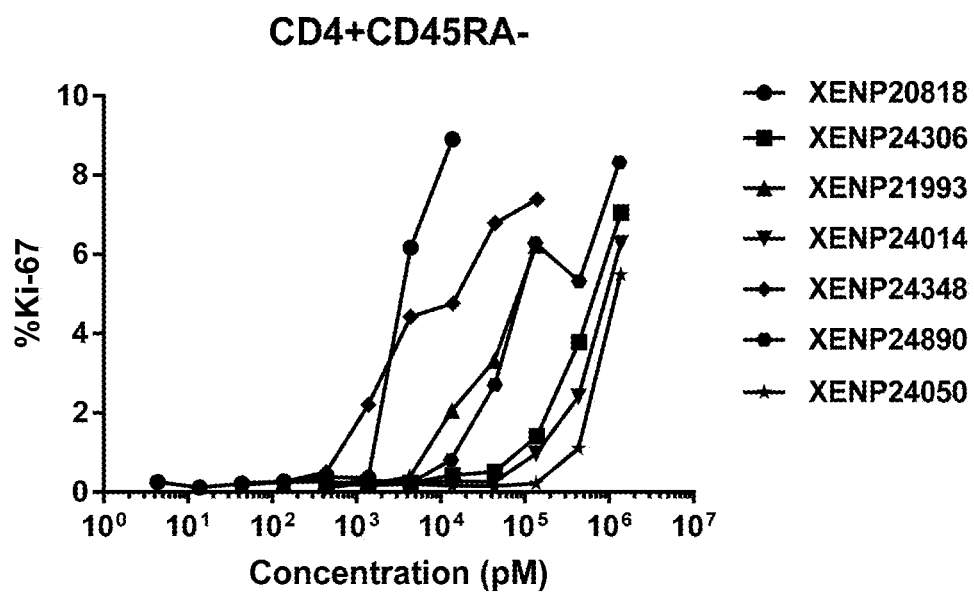
Figure 51C:
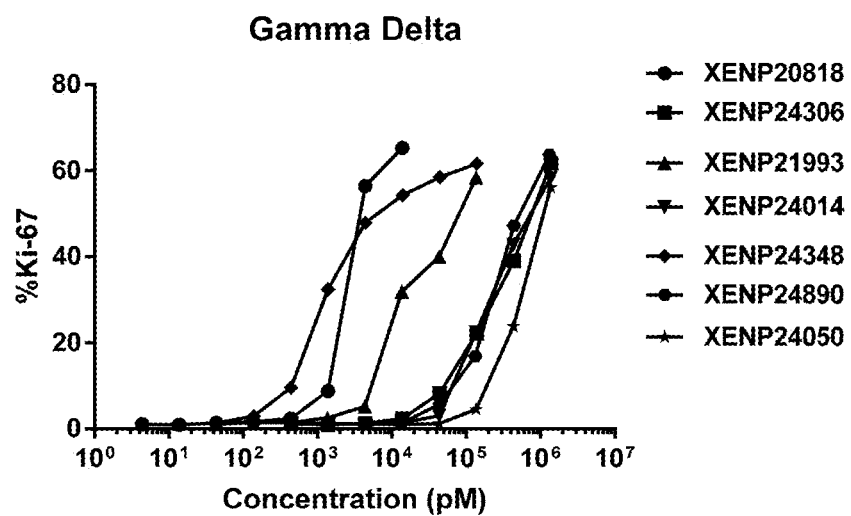
Figure 51D:
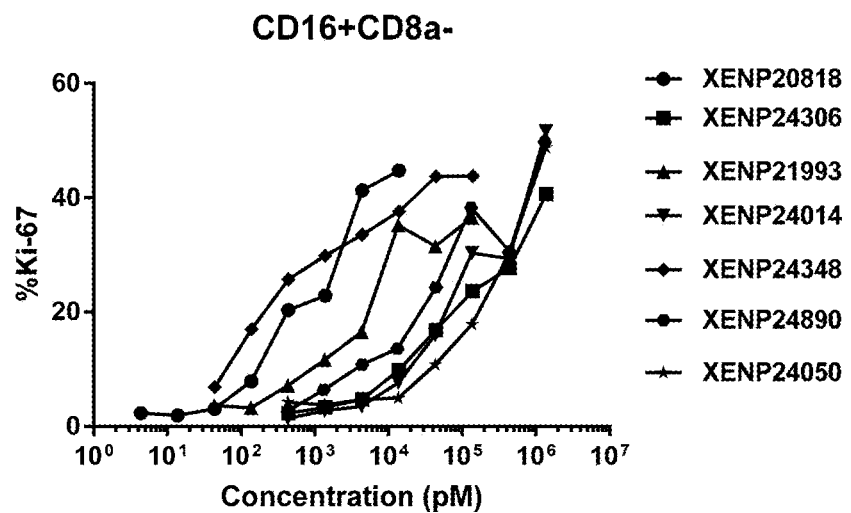
Figure 51E:
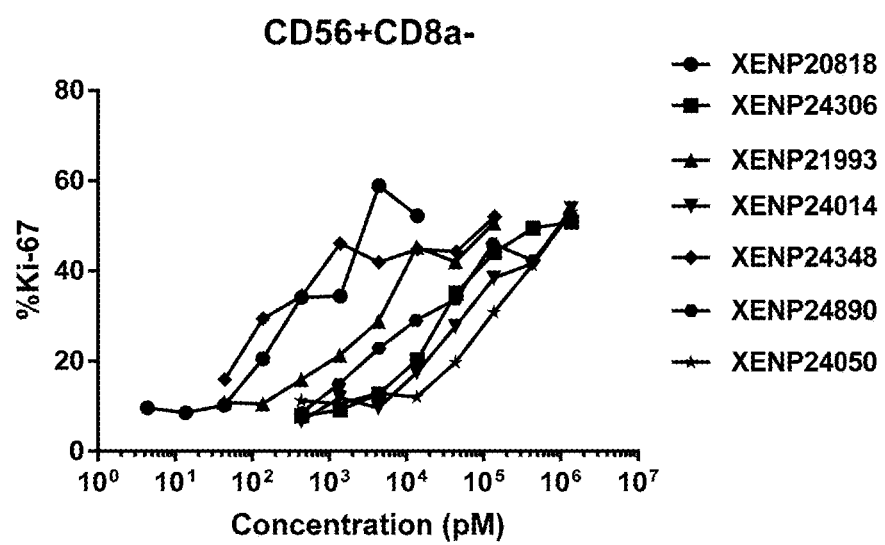
Figure 52A:
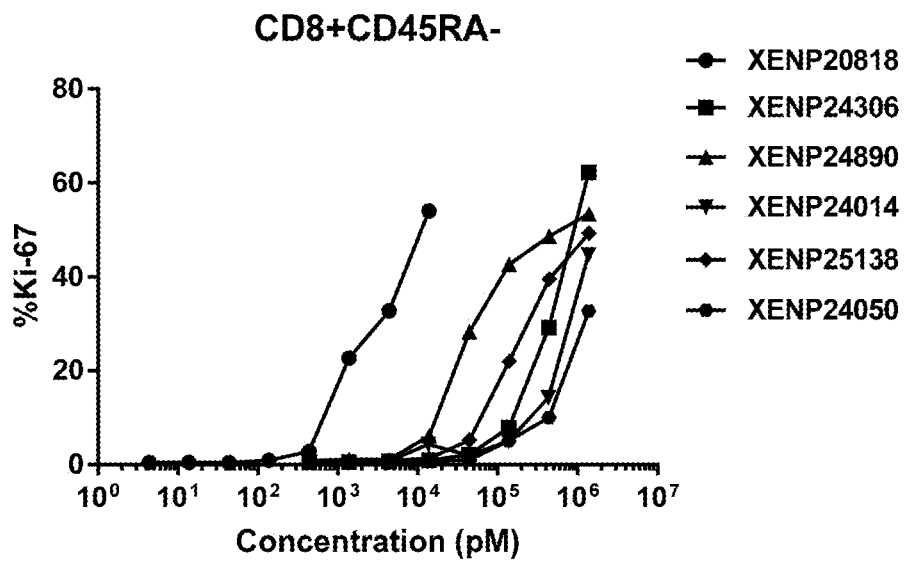
Figure 52B:
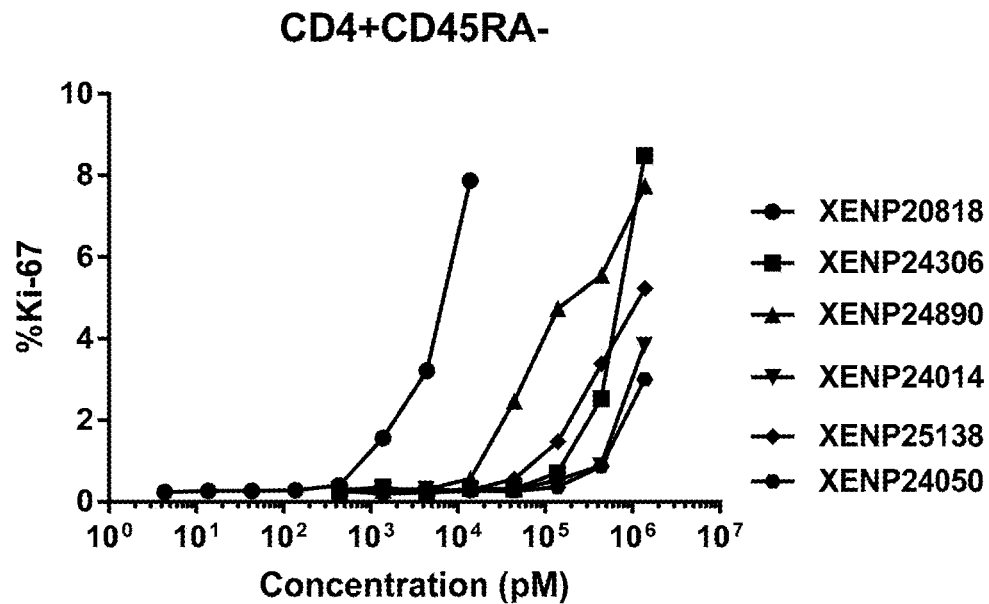
Figure 52C:
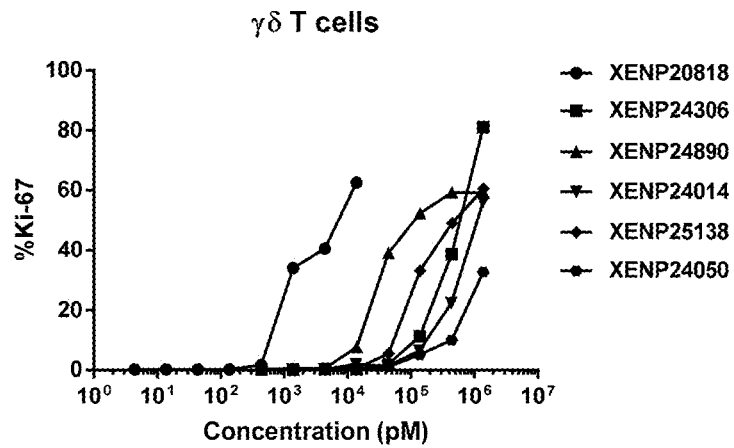
Figure 52D:
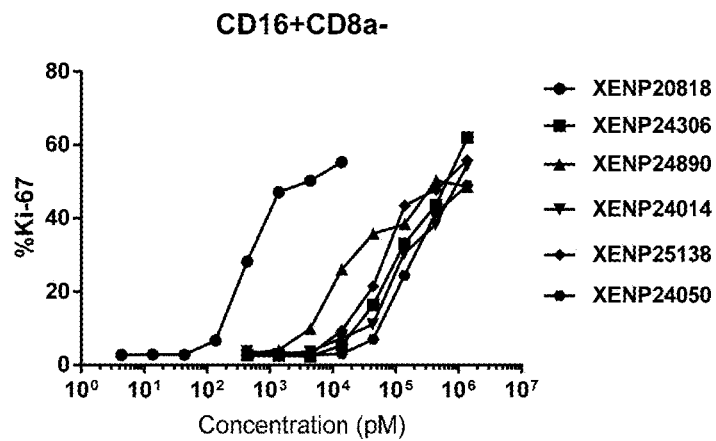
Figure 52E:
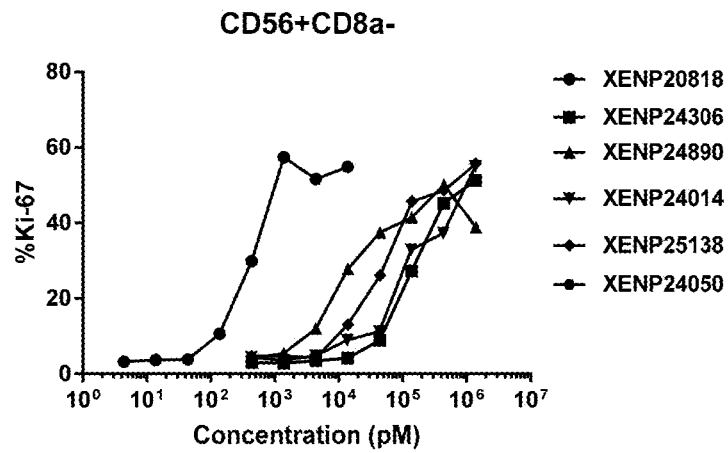
Figure 53A:
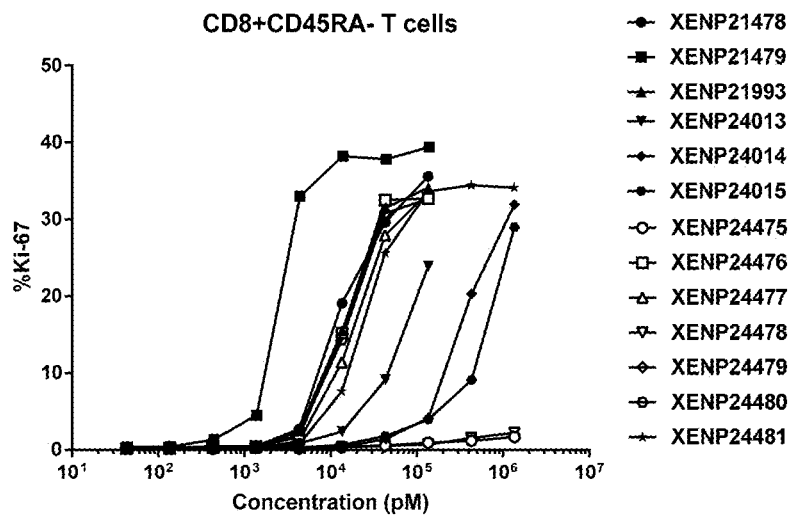
Figure 53B:
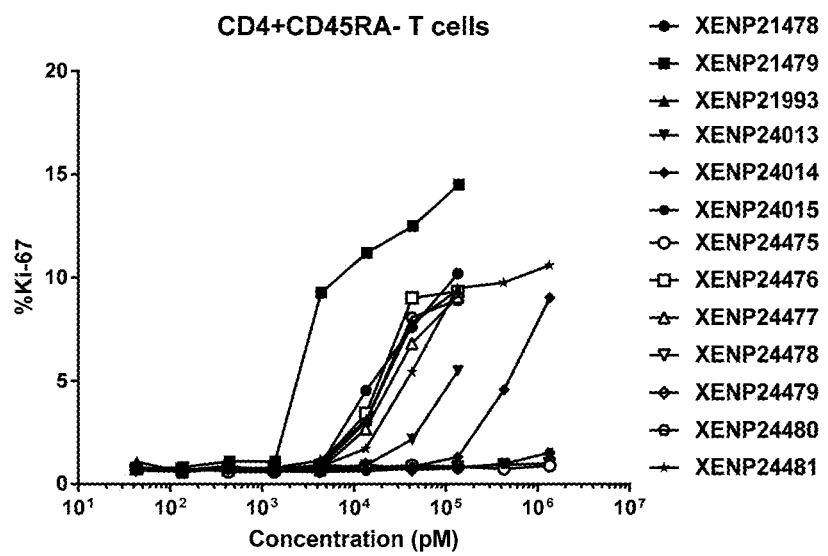
Figure 53C:
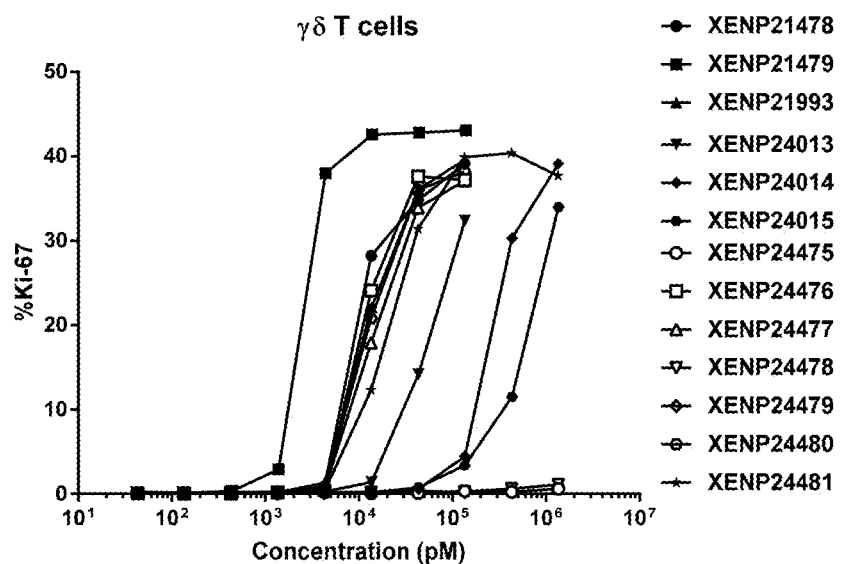
Figure 53D:
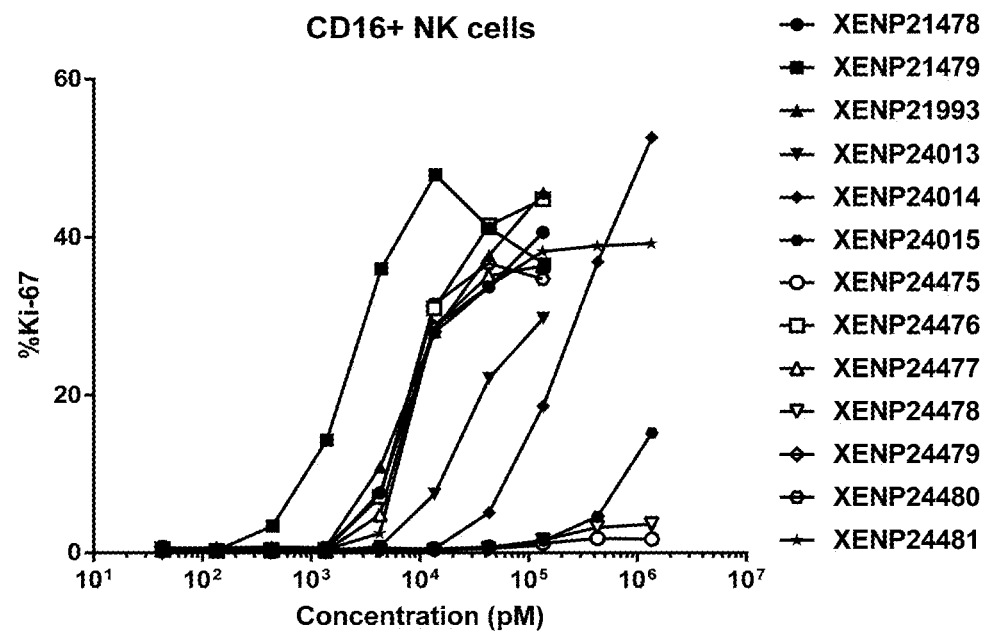

FIG. 50A-FIG. 50C depict the percentage of Ki67 expression on (FIG. 50A) CD8+ T cells, (FIG. 50B) CD4+ T cells, and (FIG. 50C) NK cells following treatment with additional IL-15/Rα variants.

FIG. 51A-FIG. 51E depict the percentage of Ki67 expression on (FIG. 51A) CD8+(CD45RA−) T cells, (FIG. 51B) CD4+(CD45RA−) T cells, (FIG. 51C) γδ T cells, (FIG. 51D) NK (CD16+CD8α−) cells, and (FIG. 51E) NK (CD56+CD8α−) cells following treatment with IL-15/Rα variants.

FIG. 52A-FIG. 52E depict the percentage of Ki67 expression on (FIG. 52A) CD8+(CD45RA−) T cells, (FIG. 52B) CD4+(CD45RA−) T cells, (FIG. 52C) γδ T cells, (FIG. 52D) NK (CD16+CD8α−) cells, and (FIG. 52E) NK (CD56+CD8α−) cells following treatment with IL-15/Rα variants.

FIG. 53A-FIG. 53D depict the percentage of Ki67 expression on (FIG. 53A) CD8+ T cells, (FIG. 53B) CD4+ T cells, (FIG. 53C) γδ T cells and (FIG. 53D) NK (CD16+) cells following treatment with additional IL-15/Rα variants.

FIG. 54A-FIG. 54D depict the percentage of Ki67 expression on (FIG. 54A) CD8+ T cells, (FIG. 54B) CD4+ T cells, (FIG. 54C) γδ T cells and (FIG. 54D) NK (CD16+) cells following treatment with additional IL-15/Rα variants.

Figure 55:
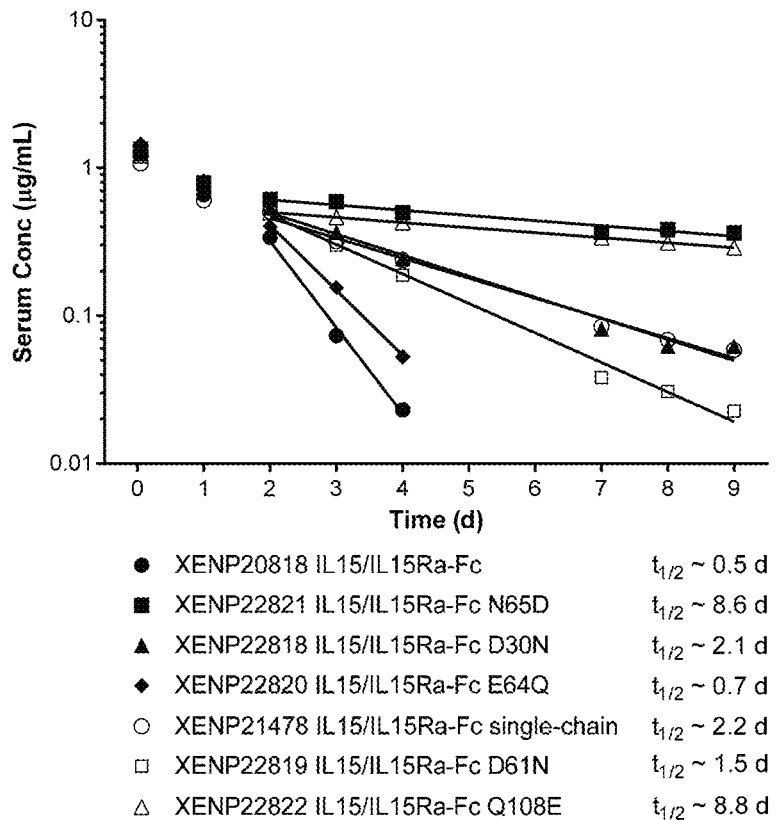

FIG. 55 depicts IV-TV Dose PK of various IL-15/Rα Fc fusion proteins or controls in C57BL/6 mice at 0.1 mg/kg single dose.

Figure 56:
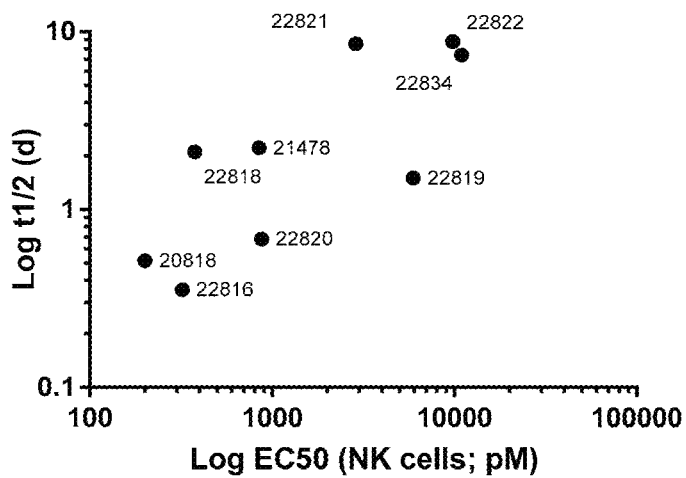

FIG. 56 depicts the correlation of half-life vs NK cell potency following treatment with IL-15/Rα-Fc fusion proteins engineered for lower potency.

FIG. 57A-FIG. 57K depict several formats for the X-targeted IL-15/Rα-Fc fusion proteins of the present invention. X may be, but is not limited to, CD8, NKG2A, and NKG2D. The "scIL-15/Rα x scFv" format FIG. 57A) comprises IL-15Rα(sushi) fused to IL-15 by a variable length linker (termed "scIL-15/Rα") which is then fused to the N-terminus of a heterodimeric Fc-region, with an scFv fused to the other side of the heterodimeric Fc. The "scFv x ncIL-15/Rα" format (FIG. 57B) comprises an scFv fused to the N-terminus of a heterodimeric Fc-region, with IL-15Rα(sushi) fused to the other side of the heterodimeric Fc, while IL-15 is transfected separately so that a non-covalent IL-15/Rα complex is formed. The "scFv x dsIL-15/Rα" format (FIG. 57C) is the same as the "scFv x ncIL-15/Rα" format, but wherein IL-15Rα(sushi) and IL-15 are covalently linked as a result of engineered cysteines. The "scIL-15/Rα x Fab" format (FIG. 57D) comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH. The "ncIL-15/Rα x Fab" format (FIG. 57E) comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a non-covalent IL-15/Rα complex is formed. The "dsIL-15/Rα x Fab" format (FIG. 57F) is the same as the "ncIL-15/Rα x Fab" format, but wherein IL-15Rα(sushi) and IL-15 are covalently linked as a result of engineered cysteines. The "mAb-scIL-15/Rα" format (FIG. 57G) comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form a Fabs with the VHs. The "mAb-ncIL-15/Rα" format (FIG. 57H) comprises VH fused to the N-terminus of a first and a second heterodimeric Fc, with IL-15Rα(sushi) fused to the C-terminus of one of the heterodimeric Fc-region, while corresponding light chains are transfected separately so as to form a Fabs with the VHs, and while and while IL-15 is transfected separately so that a non-covalent IL-15/Rα complex is formed. The "mAb-dsIL-15/Rα" format (FIG. 57I) is the same as the "mAb-ncIL-15/Rα" format, but wherein IL-15Rα(sushi) and IL-15 are covalently linked as a result of engineered cysteines. The "central-IL-15/Rα" format (FIG. 57J) comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs. The "central-scIL-15/Rα" format (FIG. 57K) comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form a Fabs with the VHs.

FIG. 58 depicts the sequences for illustrative anti-NKG2A mAbs based on monalizumab (as disclosed in U.S. Pat. No. 8,901,283, issued Dec. 2, 2014) as chimeric mAb (XENP24542) and as humanized mAb (XENP24542). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 59 depicts the sequences for illustrative anti-NKG2D mAbs based on MS (disclosed in U.S. Pat. No. 7,879,985, issued Feb. 1, 2011). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 60A-FIG. 60B depict the sequences for XENP24531, XENP24532, and XENP27146, illustrative NKG2A-targeted IL-15/Rα-Fc fusions of the scIL-15/Rα x Fab format. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

FIG. 61A-FIG. 61B depict the sequences for XENP24533, XENP24534, and XENP27145, illustrative NKG2D-targeted IL-15/Rα-Fc fusions of the scIL-15/Rα x Fab format. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIG. 6 and FIG. 7), and slashes (/) indicate the border(s) between IL-15, IL-15Rα, linkers, variable regions, and constant/Fc regions.

Figure 62A:
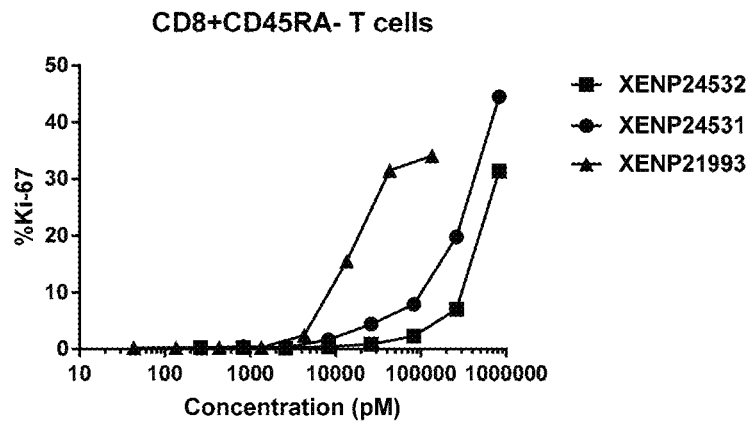
Figure 62B:
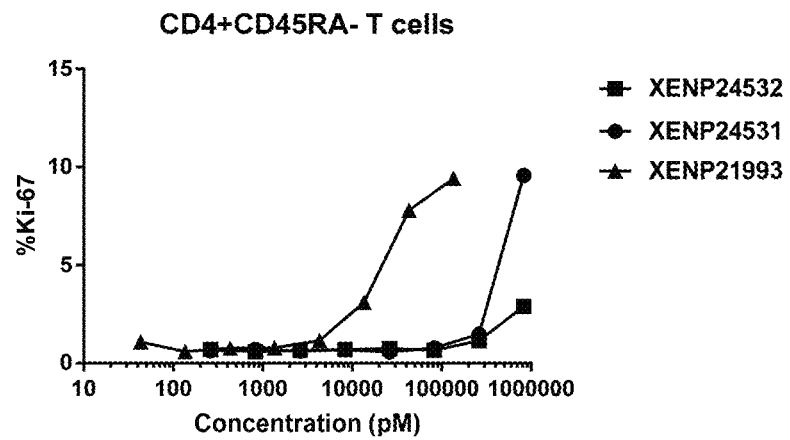
Figure 62C:
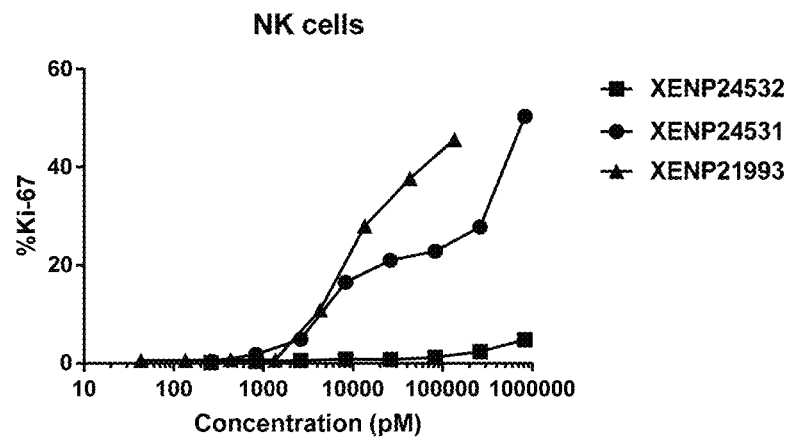

FIG. 62A-FIG. 62C depict the percentage of Ki67 expression on (FIG. 62A) CD4+ T cells, (FIG. 62B) CD8+ T cells and (FIG. 62C) NK cells following treatment with NKG2A-targeted reduced potency IL-15/Rα-Fc fusions (and control scIL-15/Rα-Fc).

Figure 63A:
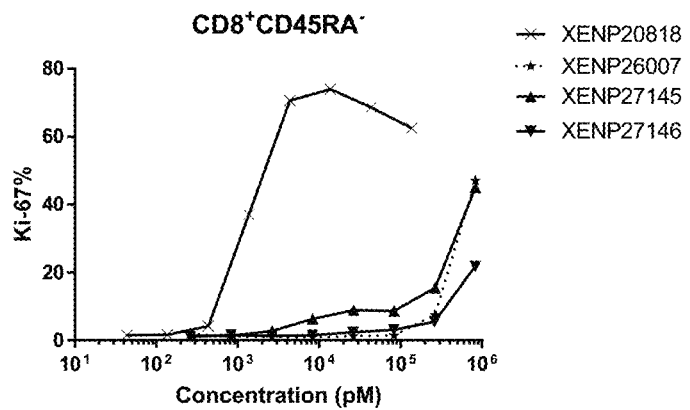
Figure 63B:
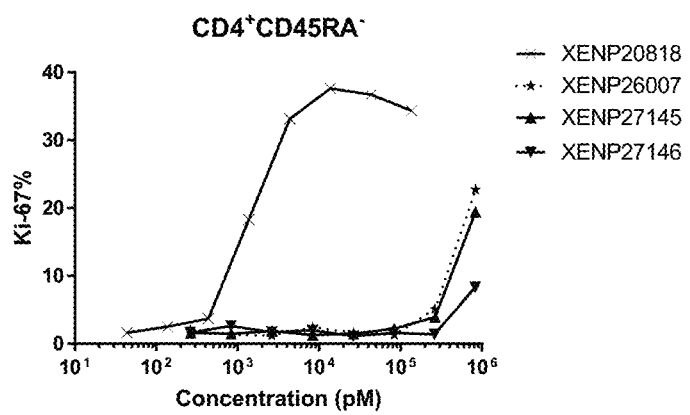
Figure 63C:
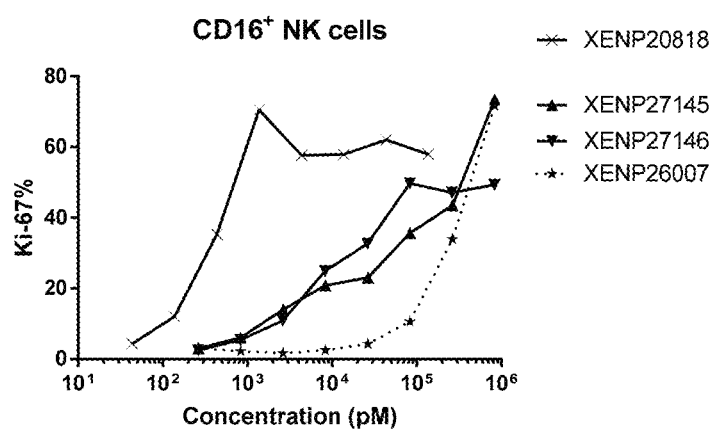
Figure 64A:
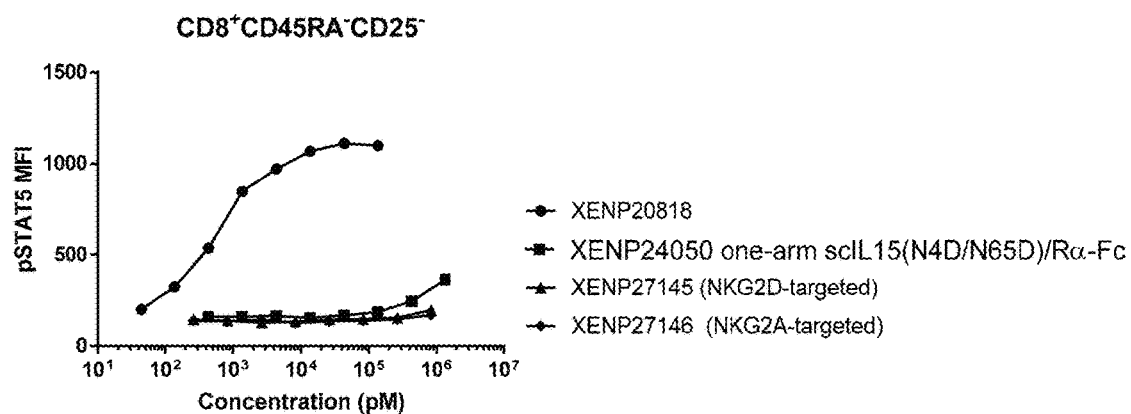
Figure 64B:
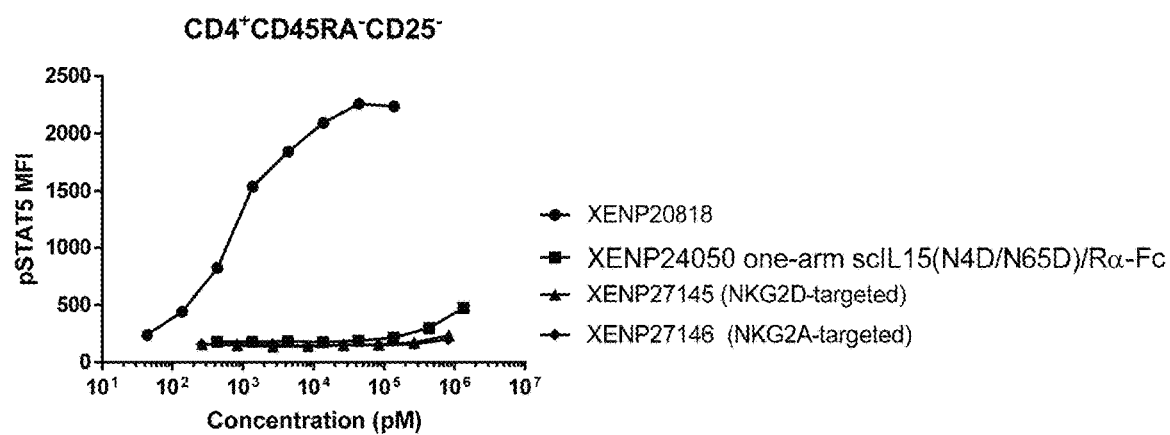
Figure 64C:
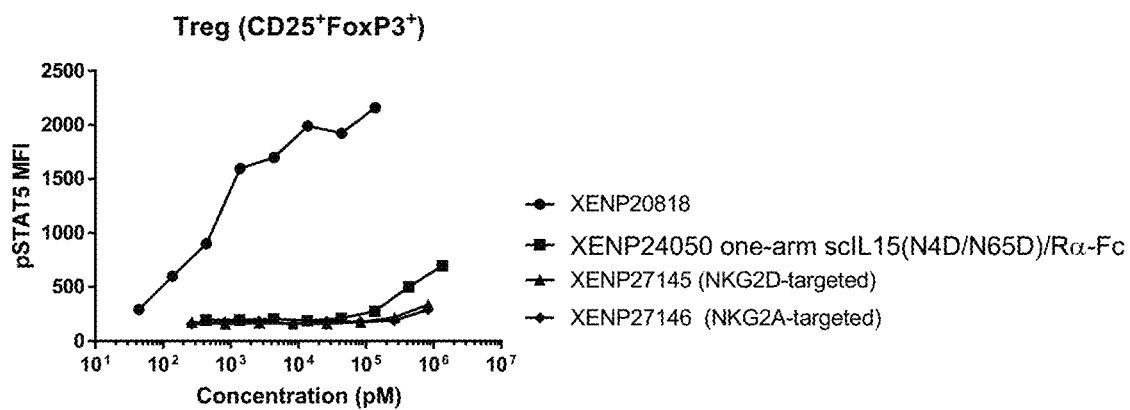
Figure 64D:
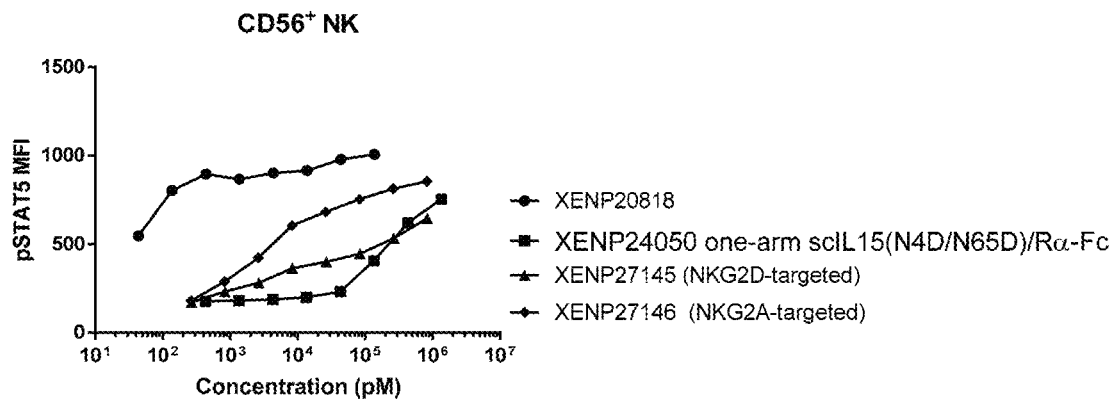

FIG. 63A-FIG. 63C depict percentage of (FIG. 63A) CD8+CD45RA– T cells, (FIG. 63B) CD4+CD45RA– T cells, and (FIG. 63C) CD16+ NK cells expressing Ki-67, a protein strictly associated with cell proliferation, in human PBMCs treated with the indicated test articles.

FIG. 64A-FIG. 64D depict STAT5 phosphorylation on (FIG. 64A) CD8+CD45RA–CD25– T cells, (FIG. 64B) CD4+CD45RA–CD25– T cells, (FIG. 64C) Treg (CD25+ FoxP3+), and (FIG. 64D) CD56+ NK cells in human PBMCs treated with the indicated test articles.

FIG. 65A-FIG. 65B depict the sequences for illustrative CD8 binding molecules based on humanized mAb (as previously described in U.S. Pat. No. 7,657,380, issued Feb. 2, 2010) formatted as chimeric mAb (XENP15076), humanized mAb (15251), humanized Fab (XENP23647), and humanized one-arm mAb (XENP24317). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 66A-FIG. 66B depict illustrative CD8-targeted IL-15/Rα-Fc fusions in the scIL-15/Rα x Fab format. The CDRs are in bold. As noted herein and is true for every sequence herein containing CDRs, the exact identification of the CDR locations may be slightly different depending on the numbering used as is shown in Table X, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

Figure 67A:
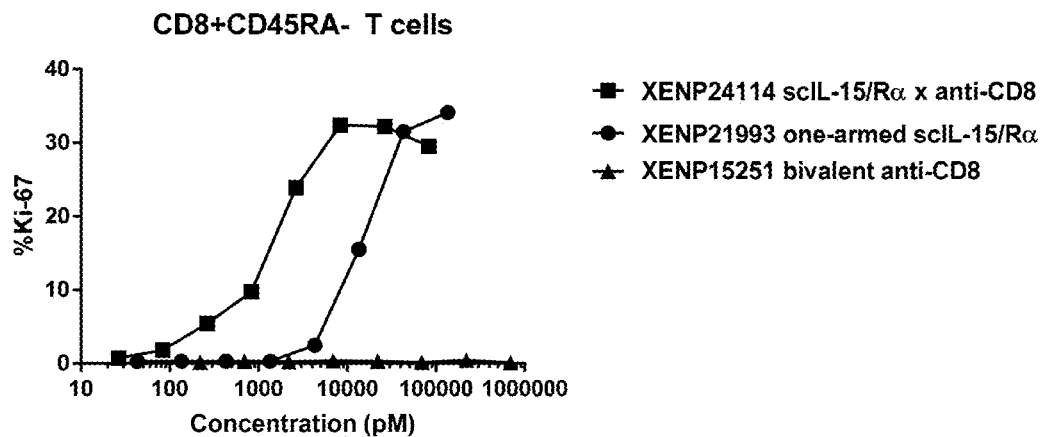
Figure 67B:
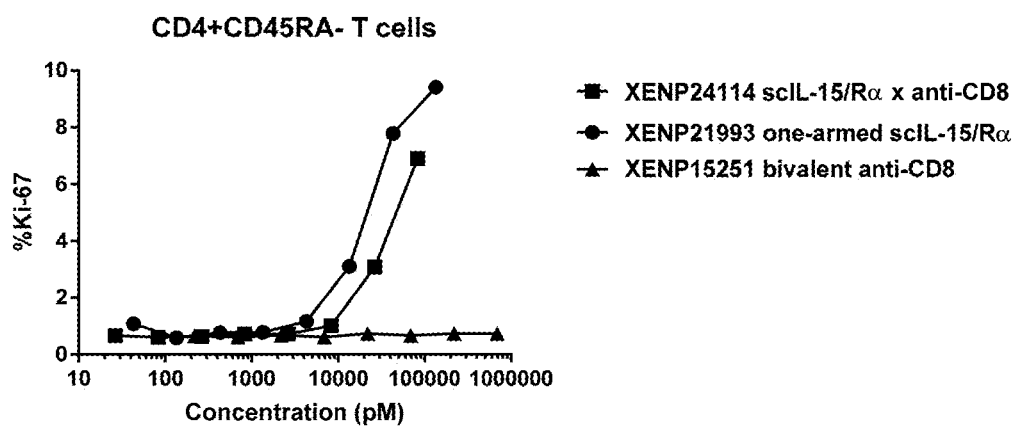
Figure 67C:
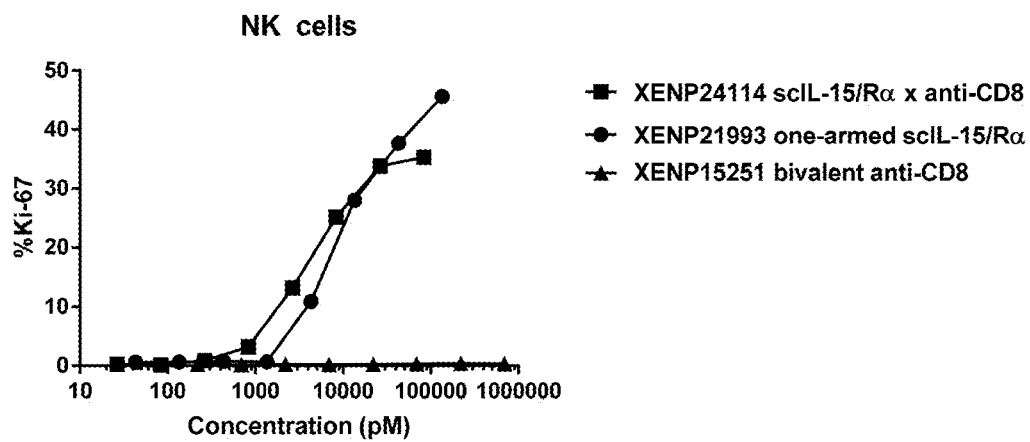

FIG. 67A-FIG. 67C depict the percentage of Ki67 expression on (FIG. 67A) CD8+ T cells, (FIG. 67B) CD4+ T cells and (FIG. 67C) NK cells following treatment with an CD9-targeted IL-15/Rα-Fc fusion (and controls anti-CD8 mAb and scIL-15/Rα-Fc).

Figure 68A:
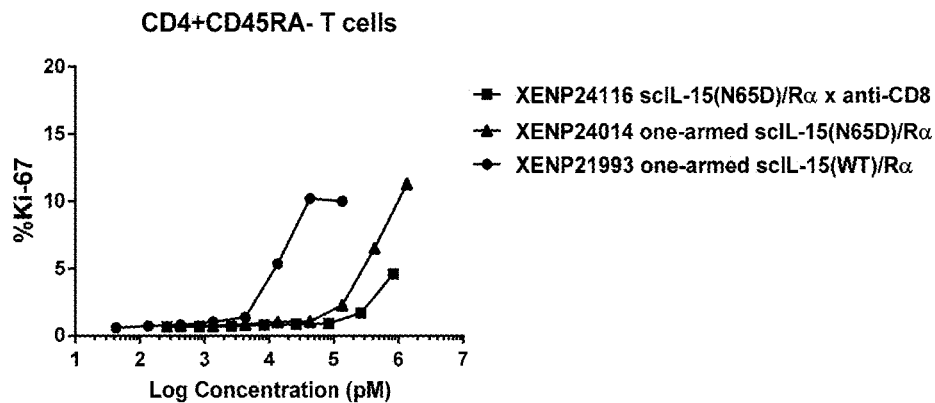
Figure 68B:
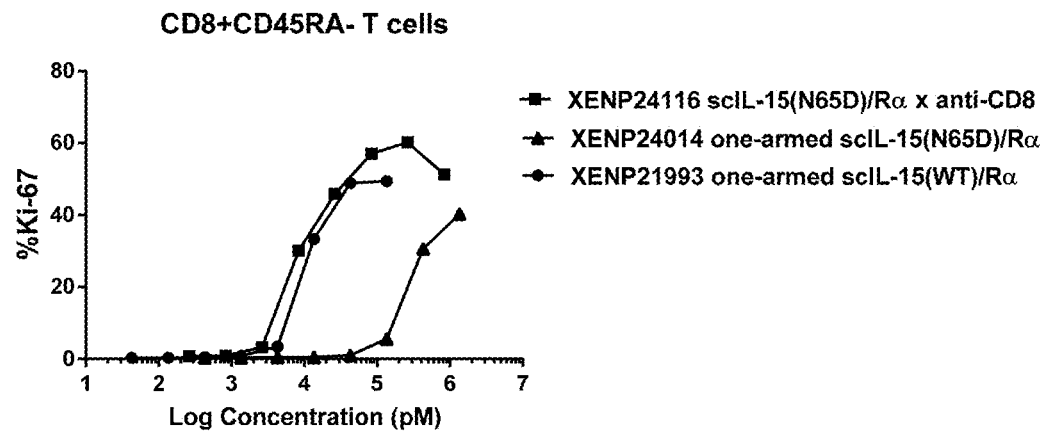
Figure 68C:
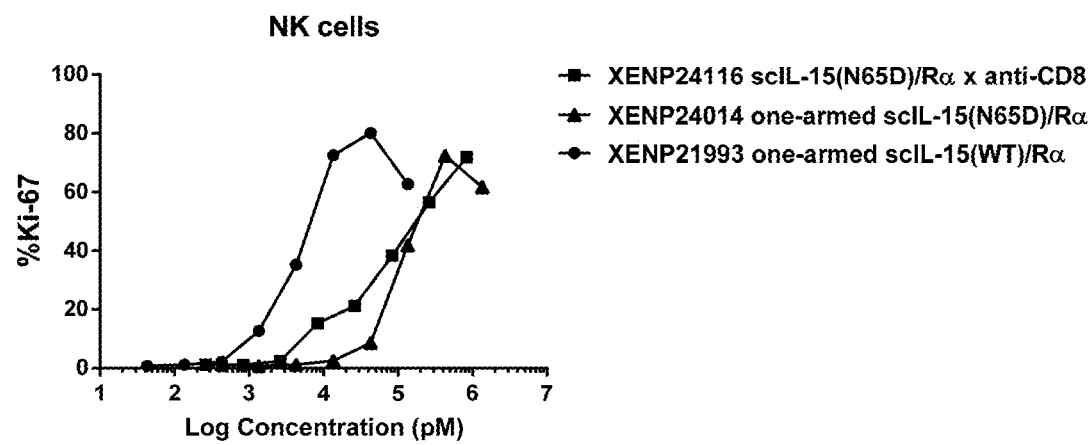

FIG. 68A-FIG. 68C depict the percentage of Ki67 expression on (FIG. 68A) CD8+ T cells, (FIG. 68B) CD4+ T cells and (FIG. 68C) NK cells following treatment with a CD8-targeted reduced potency IL-15/Rα-Fc fusion.

Figure 69A:
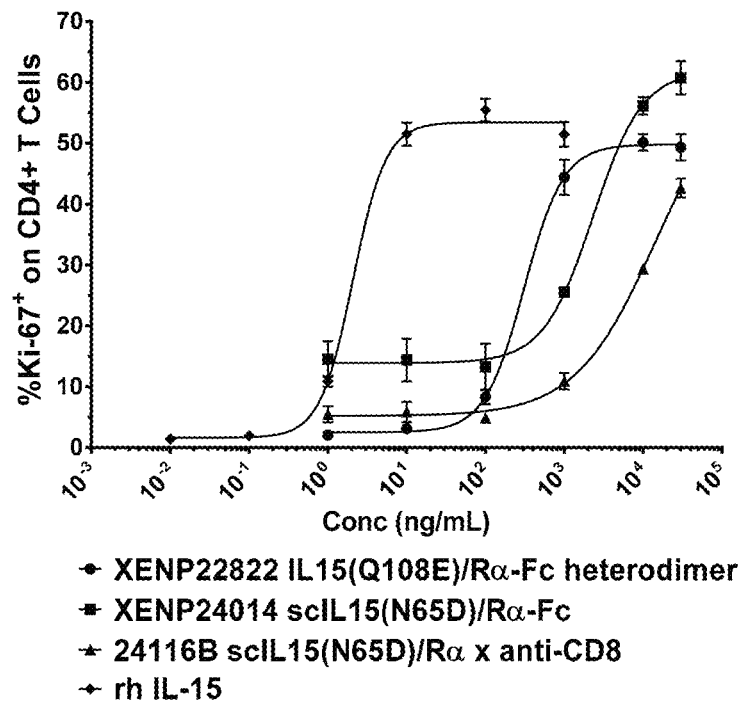
Figure 69B:
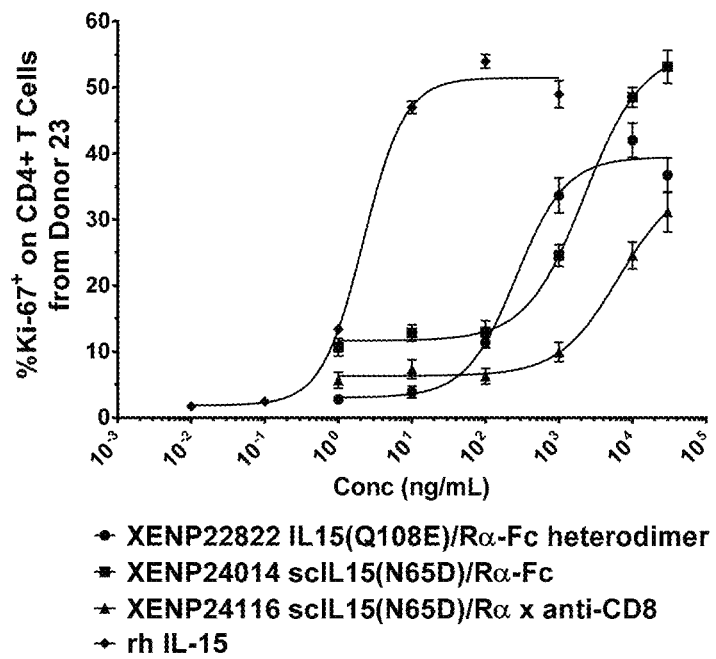

FIG. 69A-FIG. 69B depict the percentage of Ki67 expression on rapamycin enriched CD4+ T cells from (FIG. 69A) Donor 21 and (FIG. 69B) Donor 23 following treatment with CD8-targeted IL-15(N65D)/Rα-Fc fusion as well as controls.

Figure 70A:
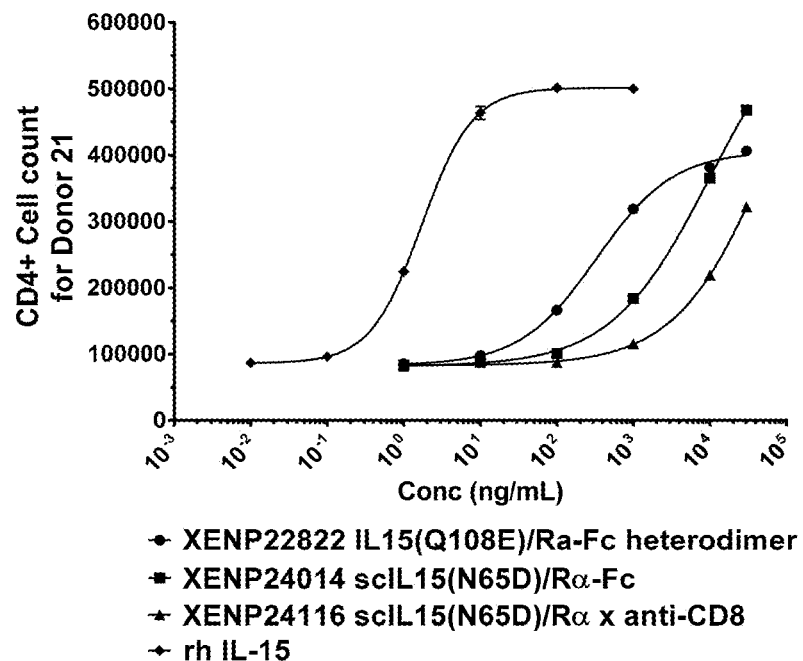
Figure 70B:
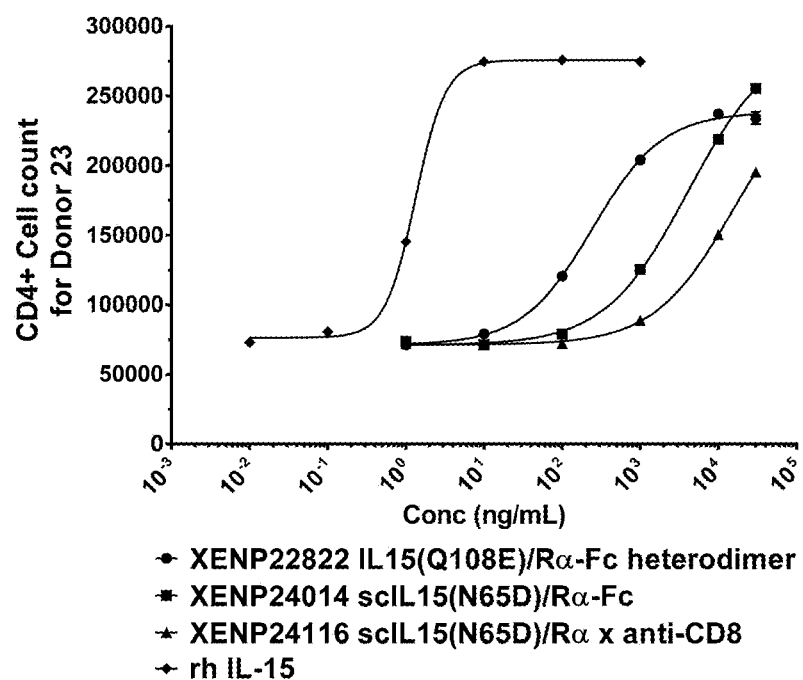

FIG. 70A-FIG. 70B depict CD4+ cell count for Tregs enriched from (FIG. 70A) Donor 21 and (FIG. 70B) Donor 23 following treatment with CD8-targeted IL-15(N65D)/Rα-Fc fusion as well as controls.

Figure 71A:
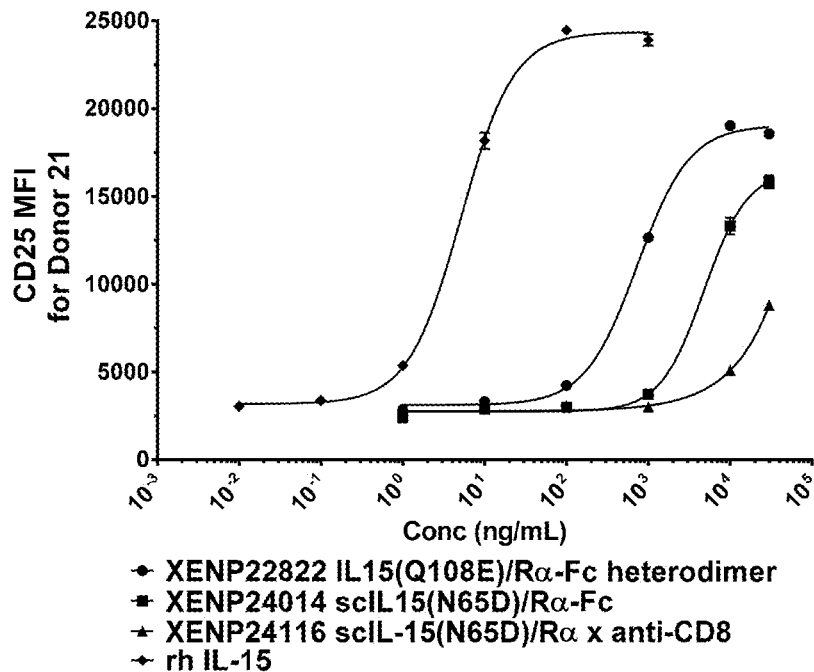
Figure 71B:
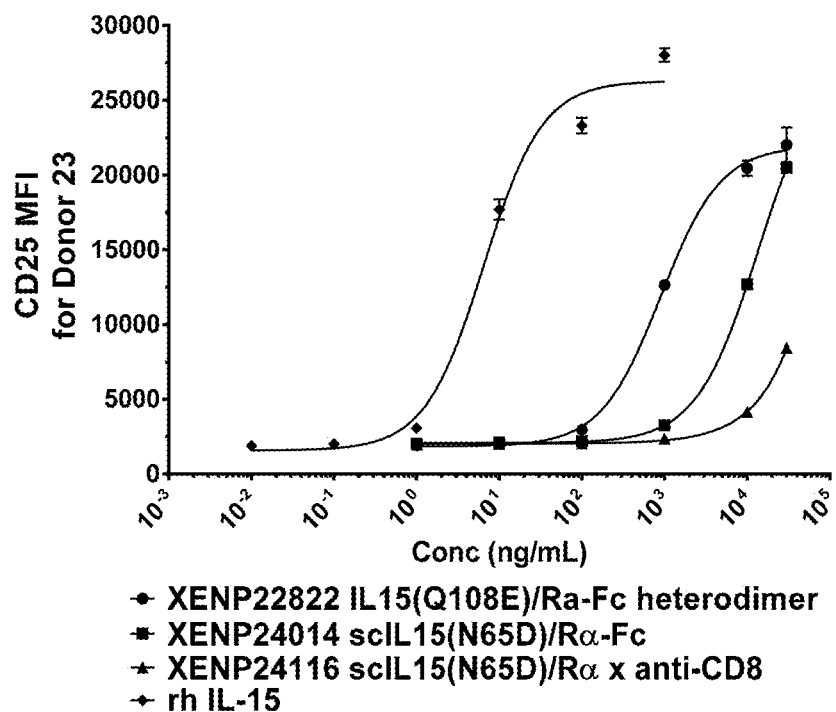

FIG. 71A-FIG. 71B depict CD25 MFI on rapamycin enriched CD4+ T cells from (FIG. 71A) Donor 21 and (FIG. 71B) Donor 23 following treatment with CD8-targeted IL-15(N65D)/Rα-Fc fusion as well as controls.

Figure 72A:
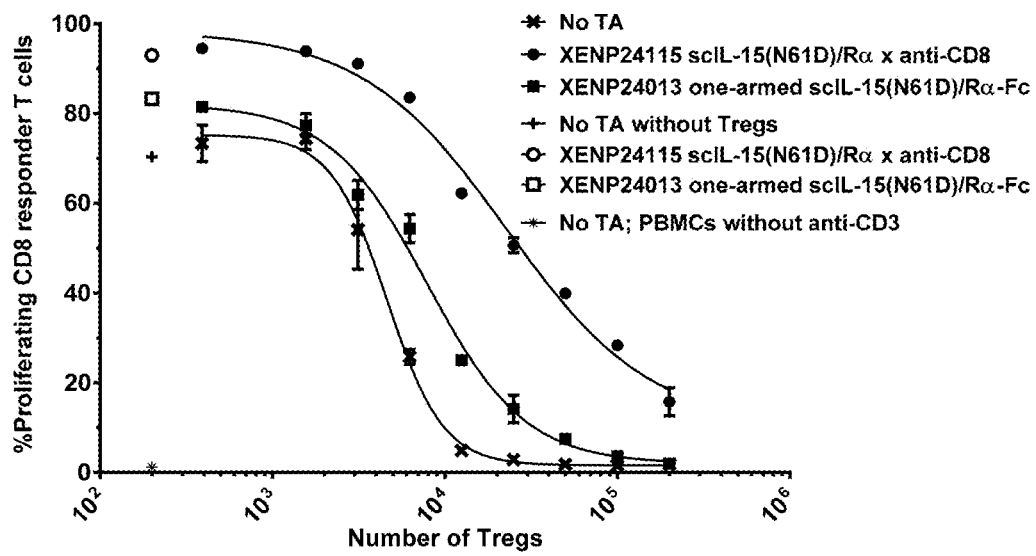
Figure 72B:
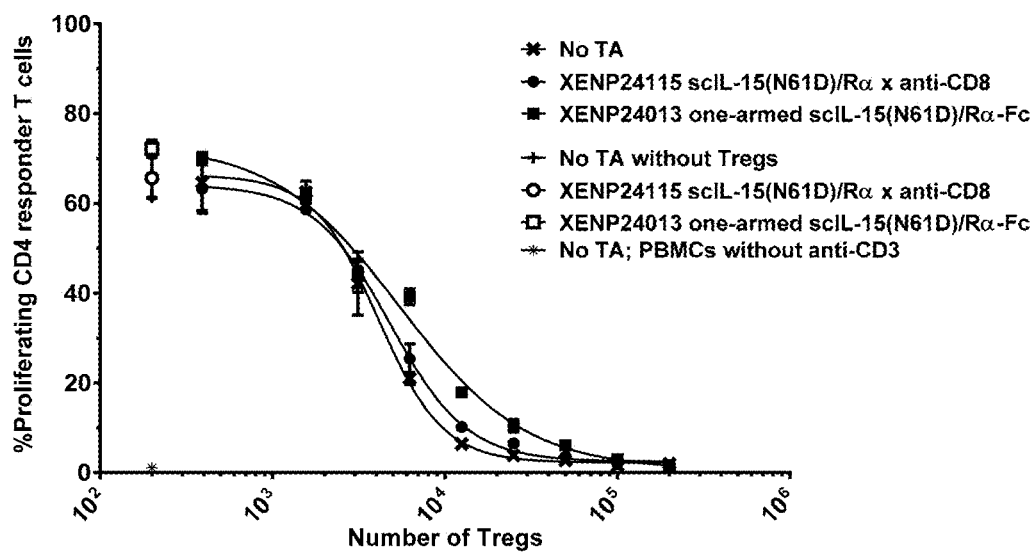
Figure 72C:
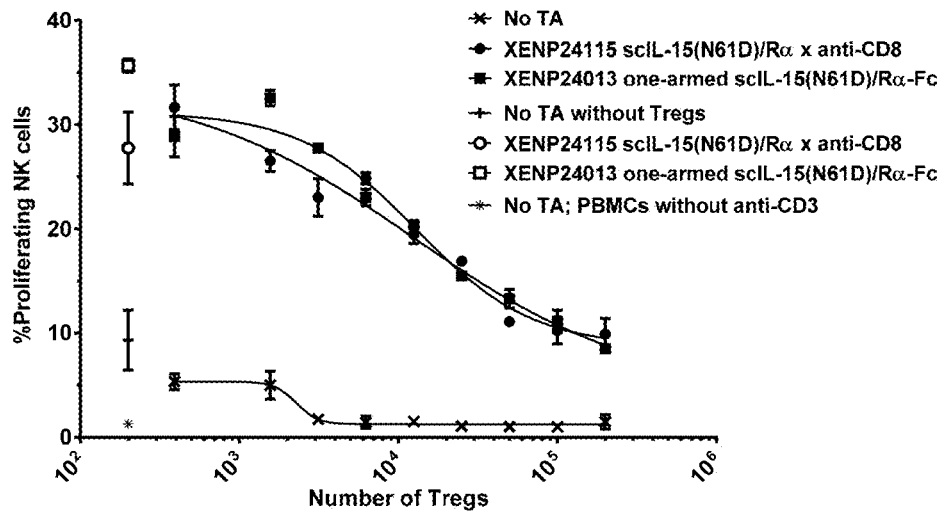

FIG. 72A-FIG. 72C depict the percentage of proliferating (FIG. 72A) CD8 responder T cell, (FIG. 72B) CD4 responder T cell, and (FIG. 72C) NK cells following treatment of PBMCs with CD8-targeted IL-15/Rα-Fc fusions in the presence of Tregs.

Figure 73:
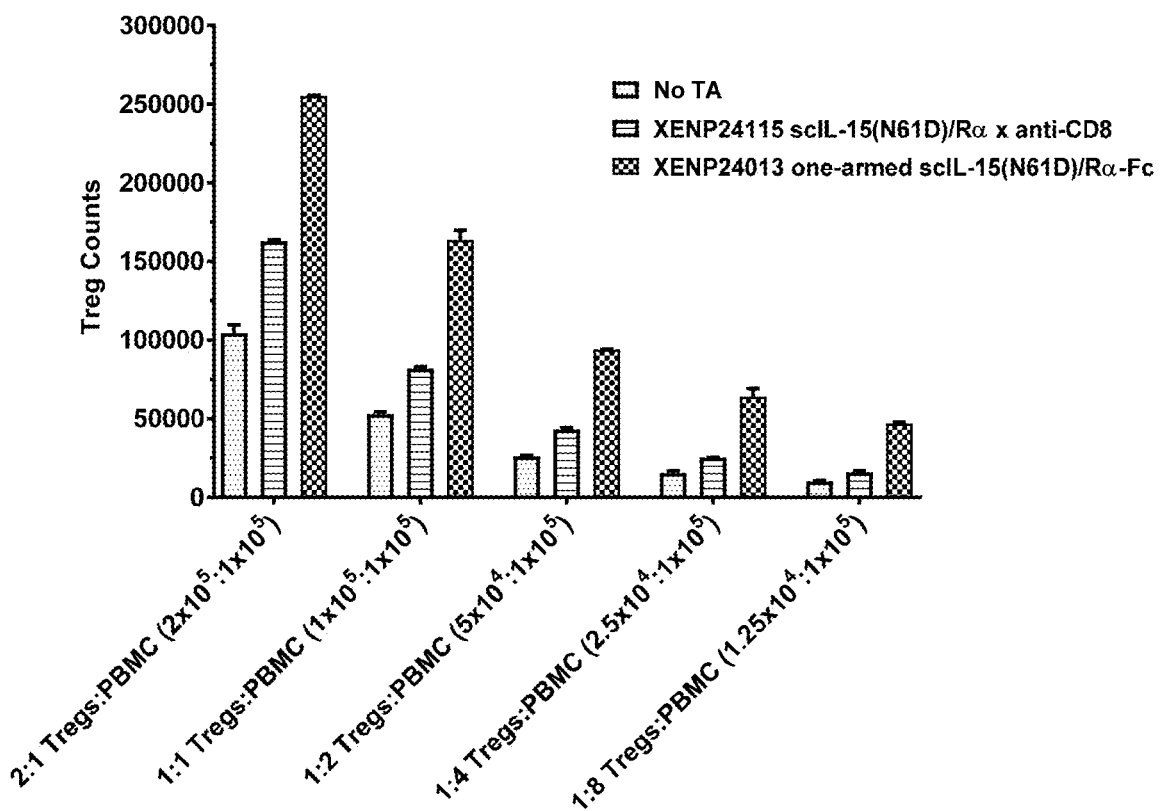

FIG. 73 depicts Treg count following treatment of PBMCs with CD8-targeted IL-15/Rα-Fc fusion in the presence of different amount of Tregs.

Figure 74A:
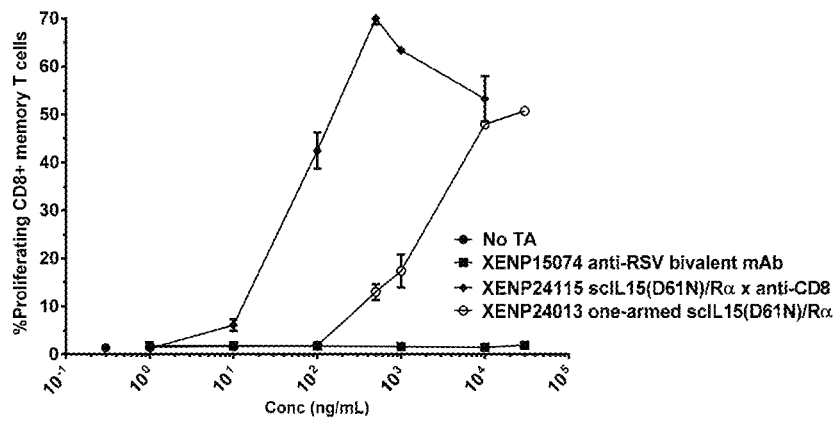
Figure 74B:
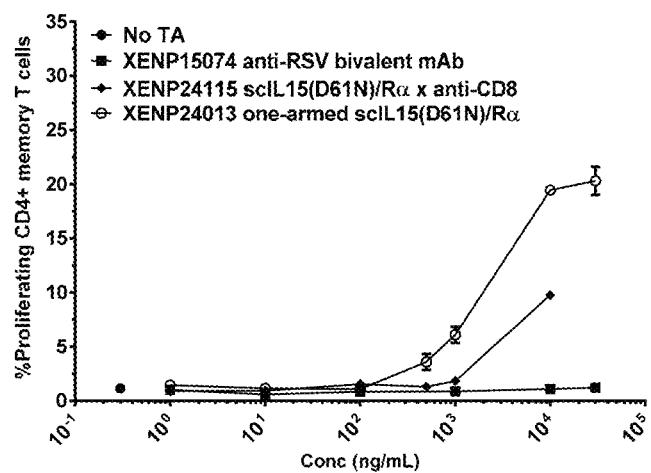
Figure 74C:
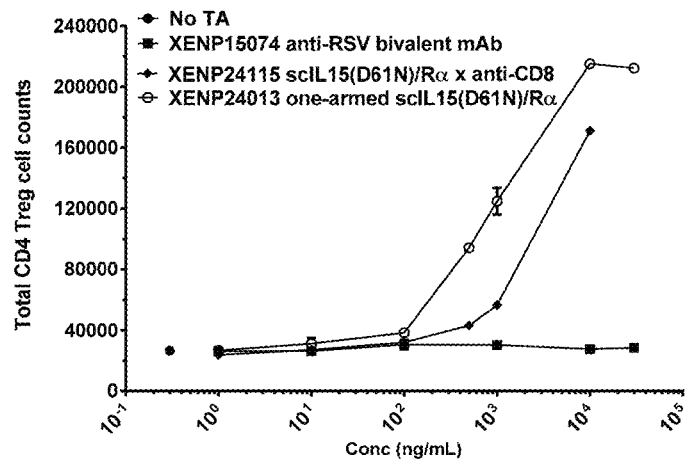

FIG. 74A-FIG. 74C depict the percentage of proliferating (FIG. 74A) CD8 memory T cell and (FIG. 74B) CD4 responder T cell and (FIG. 74C) Treg count following treatment of PBMCs with CD8-targeted IL-15/Rα-Fc fusions and controls in the presence of Tregs (1:2 Treg: PBMC ratio).

Figure 75:
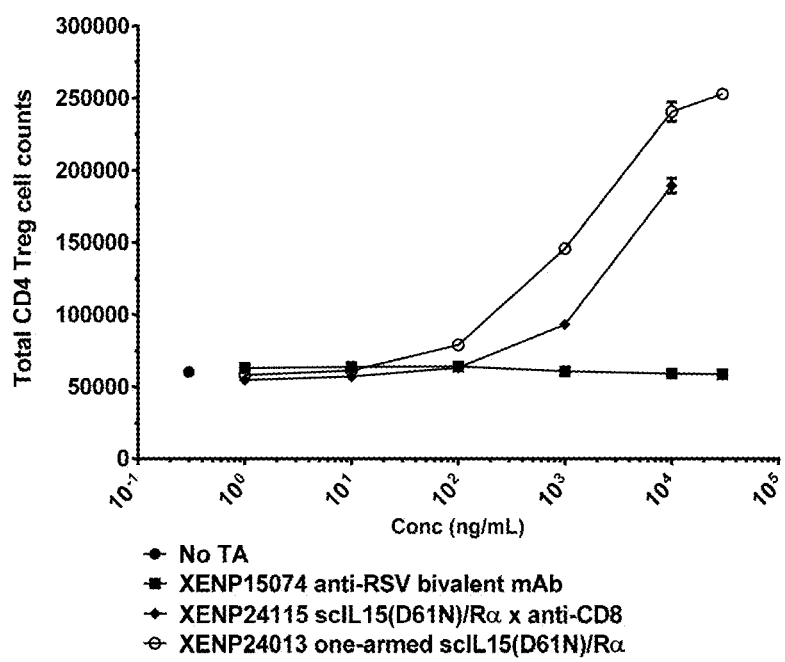
Figure 76A:
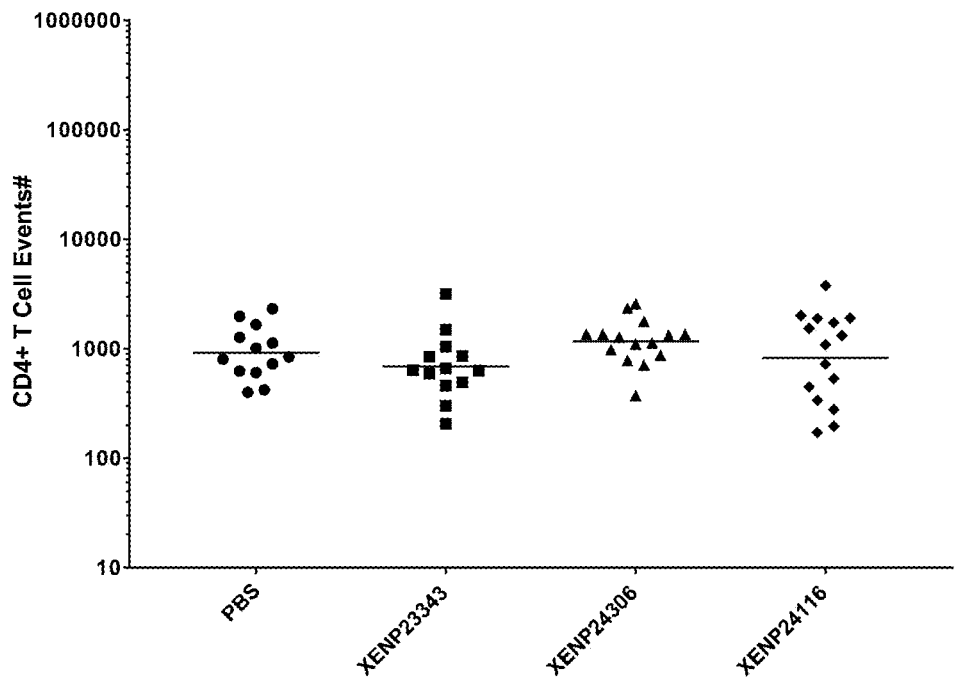
Figure 76B:
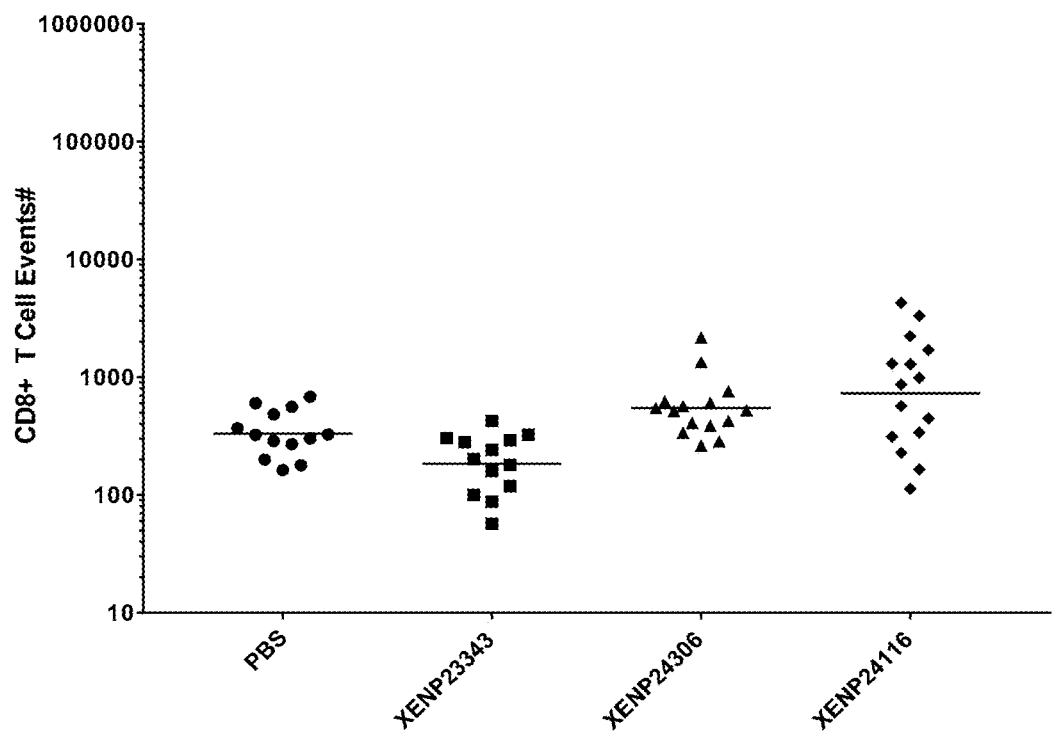
Figure 76C:
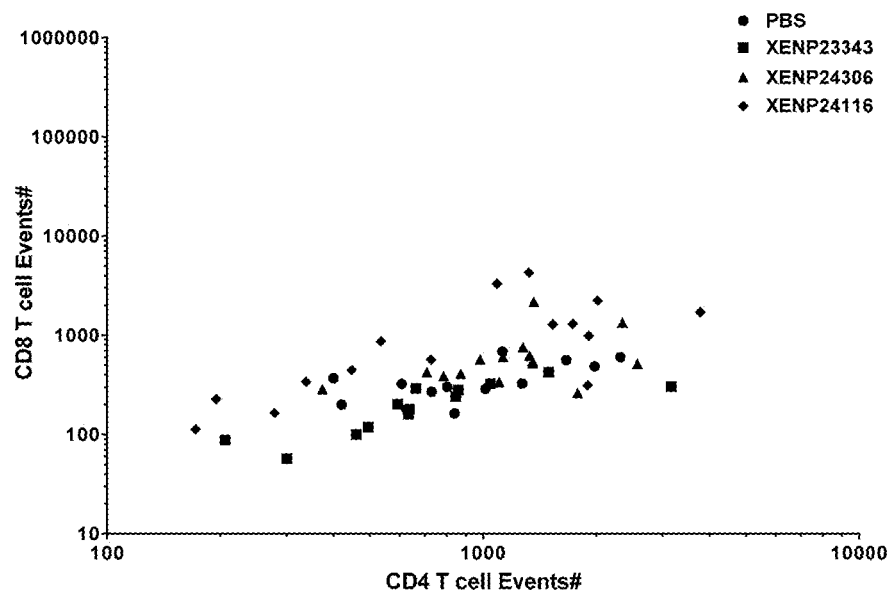
Figure 76D:
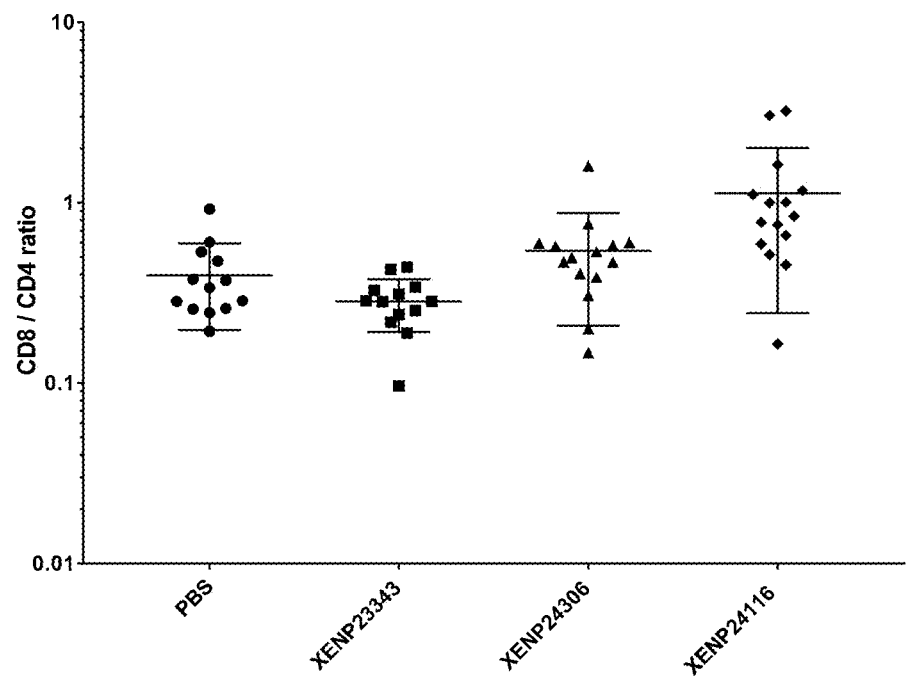
Figure 77A:
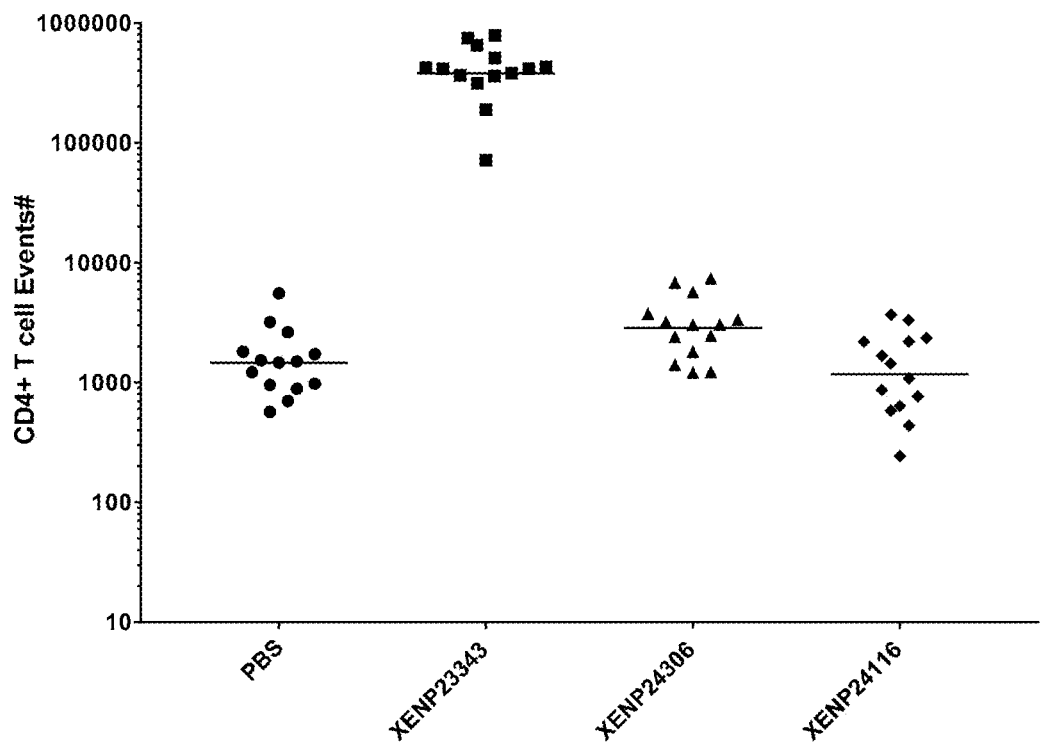
Figure 77B:
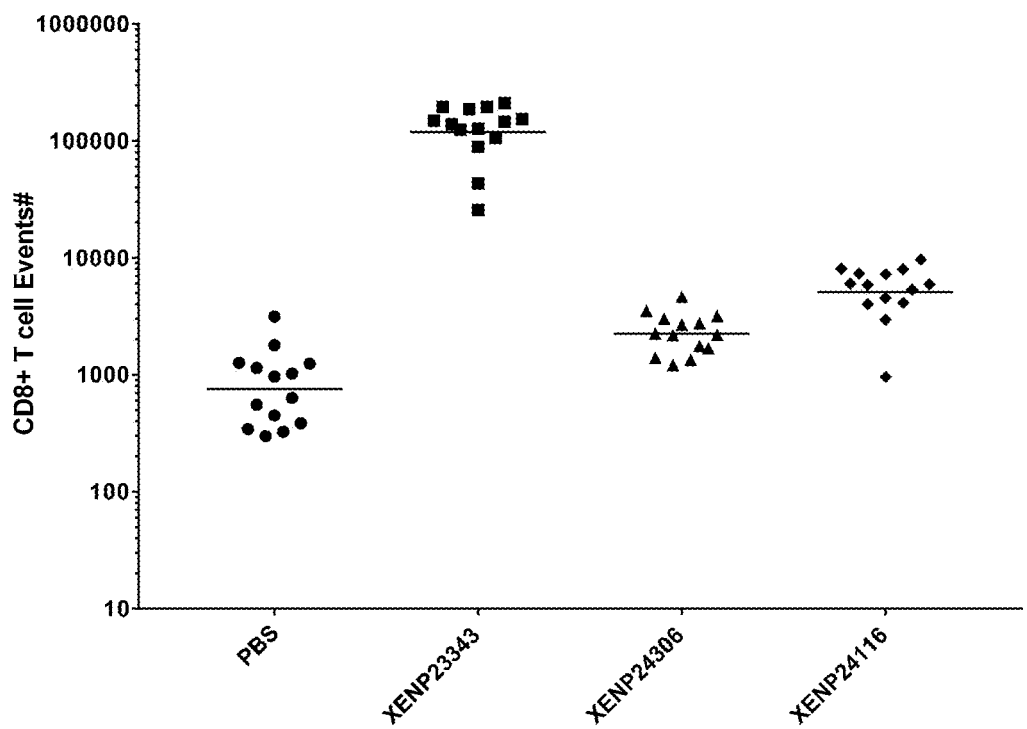
Figure 77C:
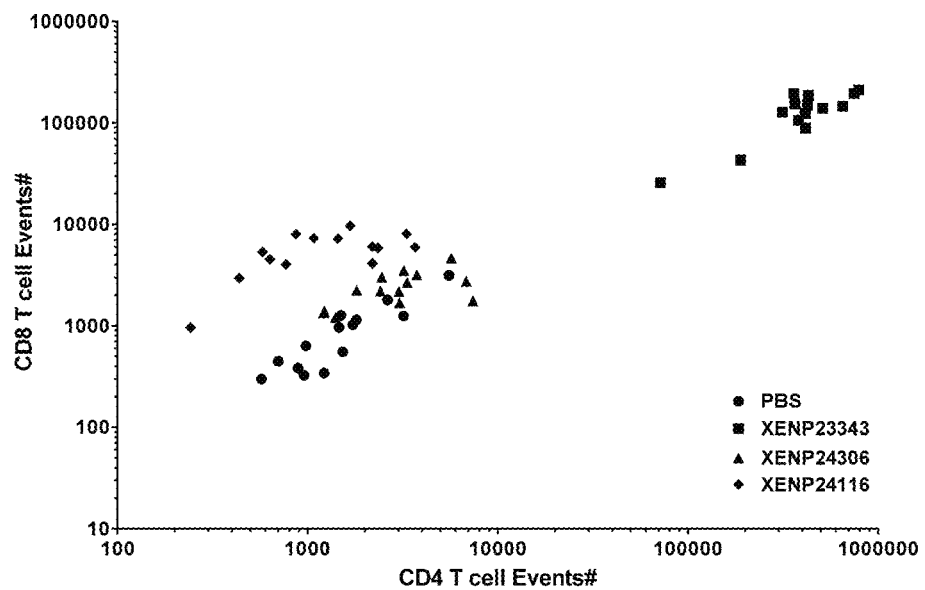
Figure 77D:
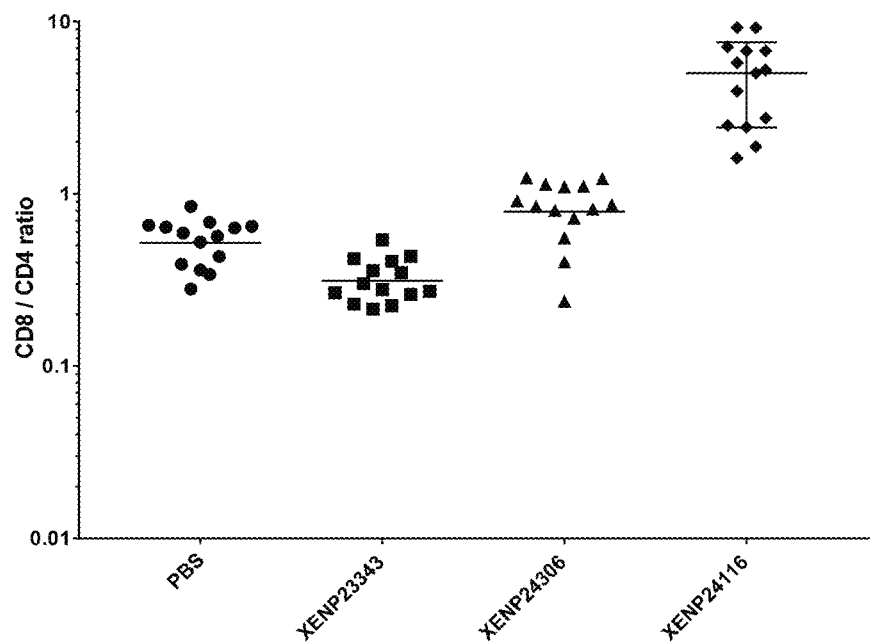
Figure 78A:
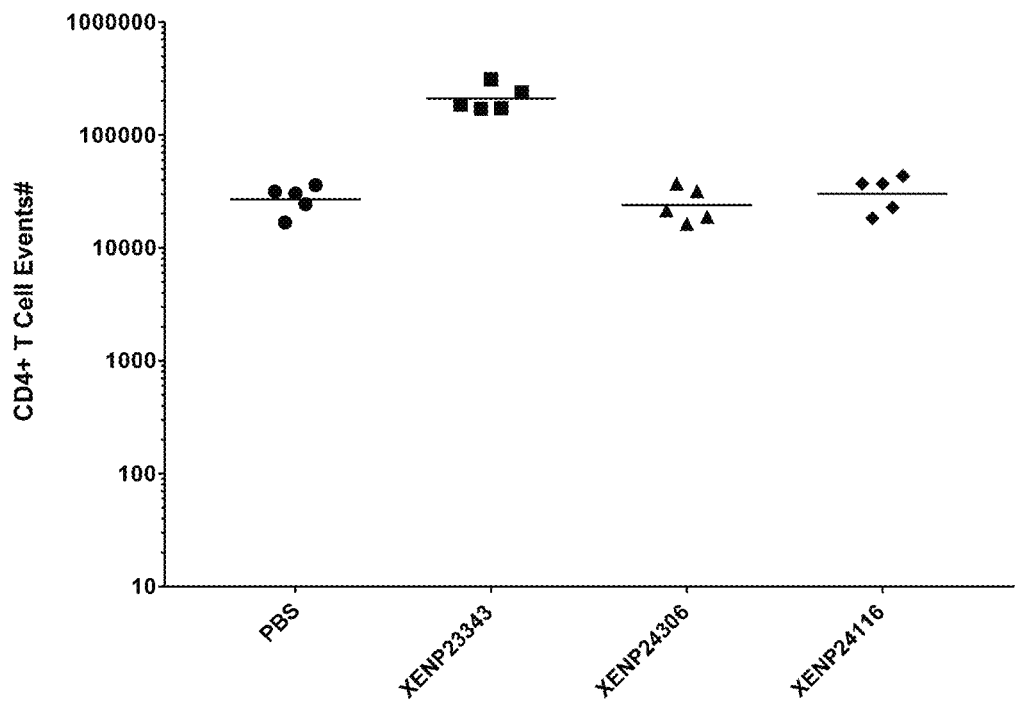
Figure 78B:
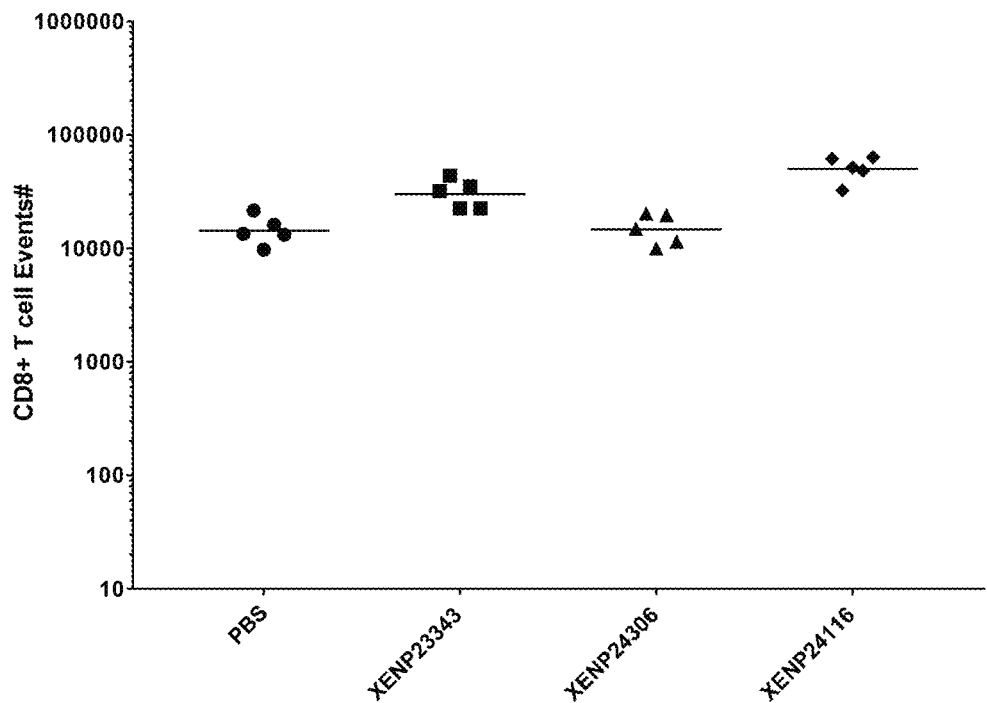
Figure 78C:
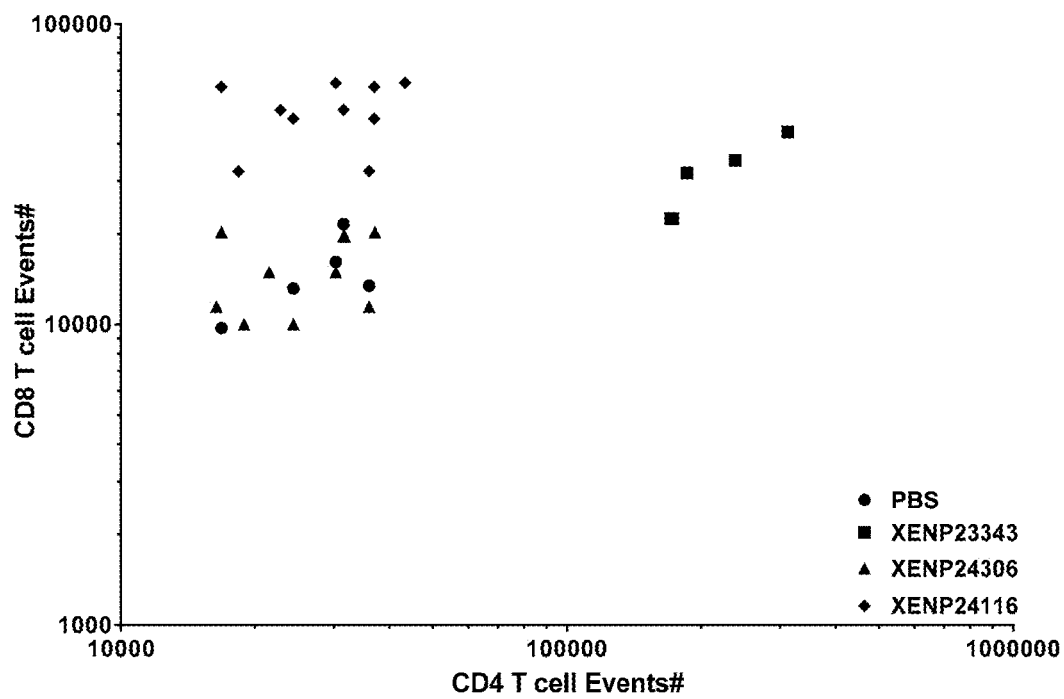
Figure 78D:
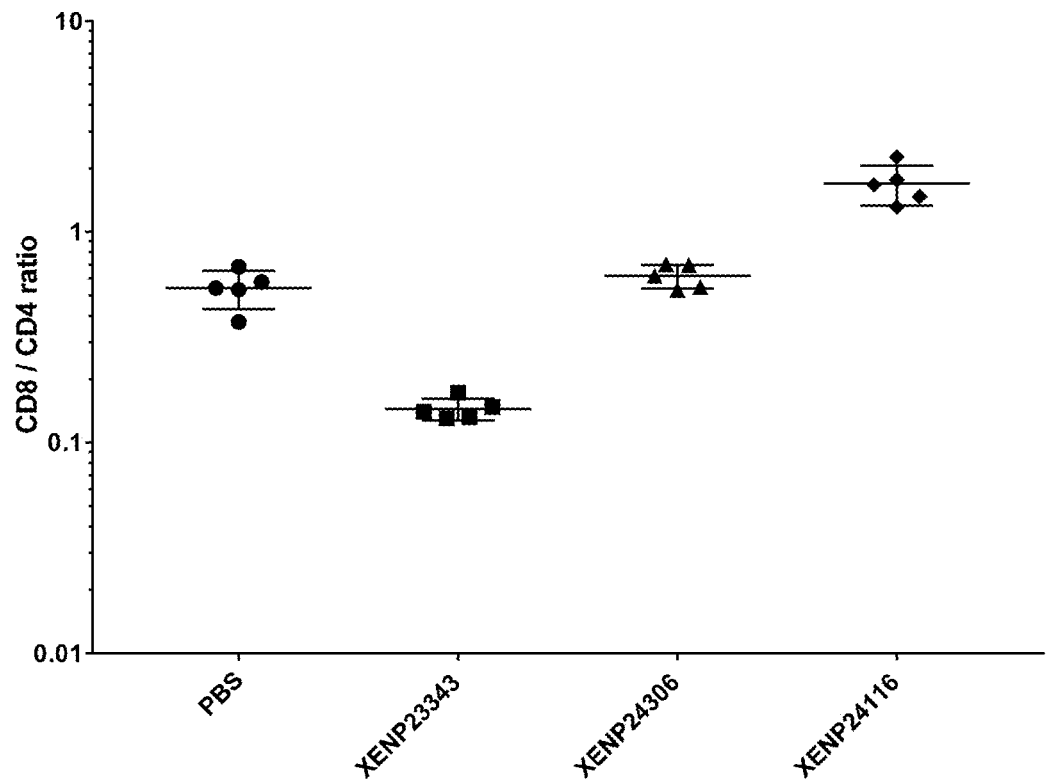

FIG. 75 depicts Treg count following treatment with CD8-targeted IL-15/Rα-Fc fusion and controls in the absence of PBMCs.

FIG. 76A-FIG. 76D depict (FIG. 76A) CD4+ T cell events, (FIG. 76B) CD8+ T cell events, (FIG. 76C) the correlation between CD8+ T cell and CD4+ T cell events and (FIG. 76D) CD8+ T cell/CD4+ T cell ratio in whole blood of huPBMC engrafted mice on Day 4 following treatment with a CD8-targeted reduced potency IL-15/Rα-Fc fusion and IL-15/Rα-Fc fusion variants.

FIG. 77A-FIG. 77D depict (FIG. 77A) CD4+ T cell events, (FIG. 77B) CD8+ T cell events, (FIG. 77C) the correlation between CD8+ T cell and CD4+ T cell events, and (FIG. 77D) CD8+ T cell/CD4+ T cell ratio in whole blood of huPBMC engrafted mice on Day 7 following treatment with a CD8-targeted reduced potency IL-15/Rα-Fc fusion and IL-15/Rα-Fc fusion variants.

FIG. 78A-FIG. 78D depict (FIG. 78A) CD4+ T cell events, (FIG. 78B) CD8+ T cell events, (FIG. 78C) the correlation between CD8+ T cell and CD4+ T cell events and (FIG. 78D) CD8+ T cell/CD4+ T cell ratio in spleen of huPBMC engrafted mice on Day 8 following treatment with a CD8-targeted reduced potency IL-15/Rα-Fc fusion and IL-15/Rα-Fc fusion variants.

FIG. 79A-FIG. 79B depict illustrative sequences for CD8-targeted IL-15/Rα-Fc fusions in alternative formats (as depicted in FIG. 57). The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIG. 6 and FIG. 7), and slashes (/) indicate the border(s) between IL-15, IL-15Rα, linkers, variable regions, and constant/Fc regions.

FIG. 80A-FIG. 80F depict the percentage of Ki67 expression on CD4+ T cells, CD8+ T cells, and NK cells following treatment with alternative format CD8-targeted IL-15/Rα-Fc fusions.

FIG. 81 depicts phage derived anti-CD8 antibody sequences. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

Figure 82:
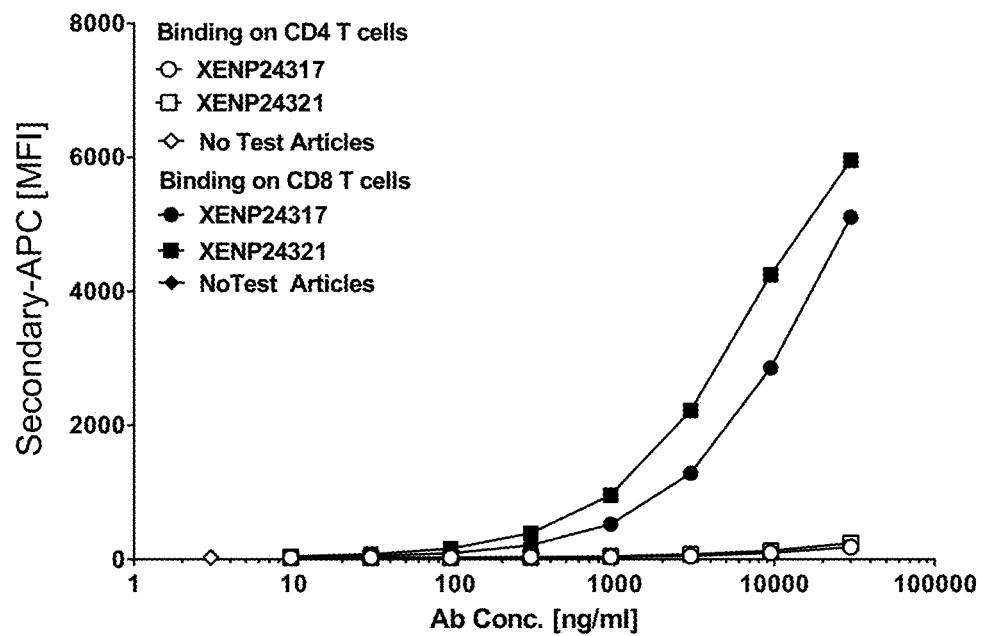

FIG. 82 depicts binding of exemplary phage hits reformatted as one-armed Fab-Fc antibodies to CD4+ and CD8+ T cells.

Figures 83A, 83B, 83C:
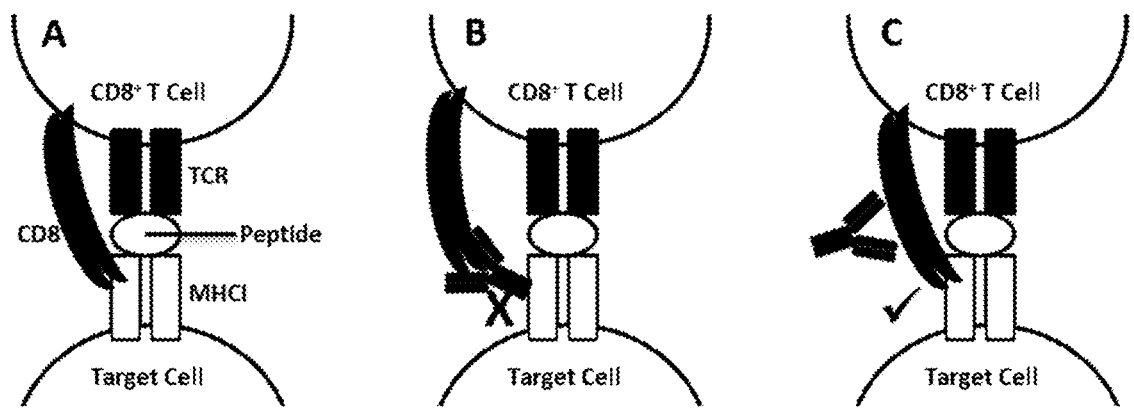

FIG. 83A-FIG. 83C diagram the binding of CD8 and TCR on CD8+ T cells to pMHCI on a target cell.

Figure 84:
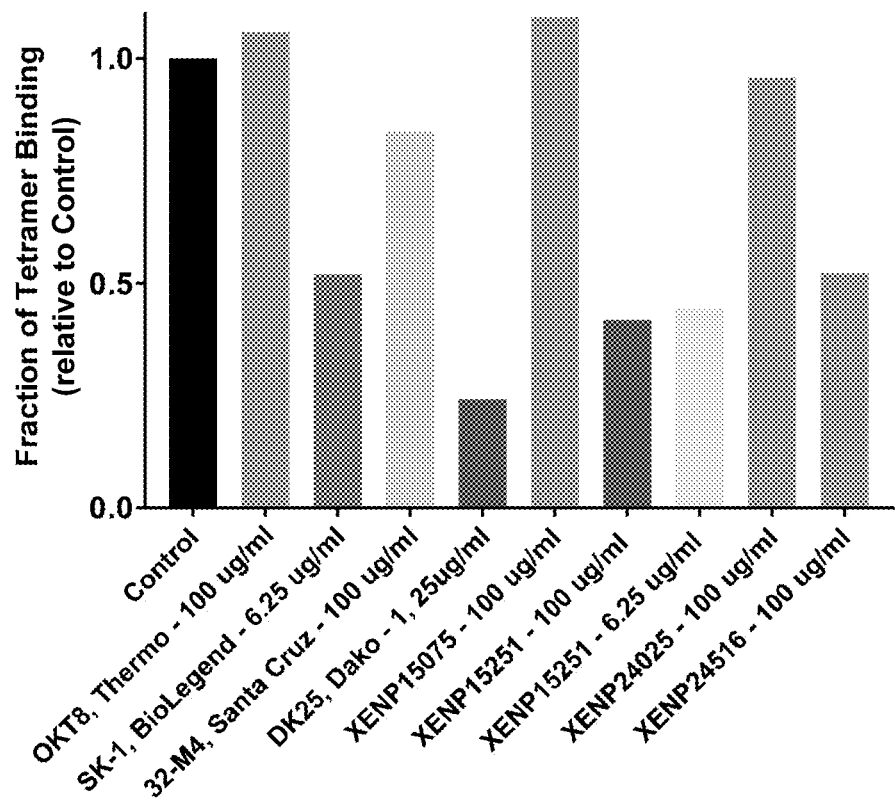

FIG. 84 depicts fraction of binding by HLA2:01 restricted MHC tetramer specific for pp65 (NLVPMVATV) peptide (SEQ ID NO: 6) to T cells specific for HLA2:01 restricted pp65 (NLVPMVATV) peptide (SEQ ID NO: 6) following pre-incubation with anti-CD8 antibodies relative to control (no pre-incubation with anti-CD8 antibody).

Figure 85:
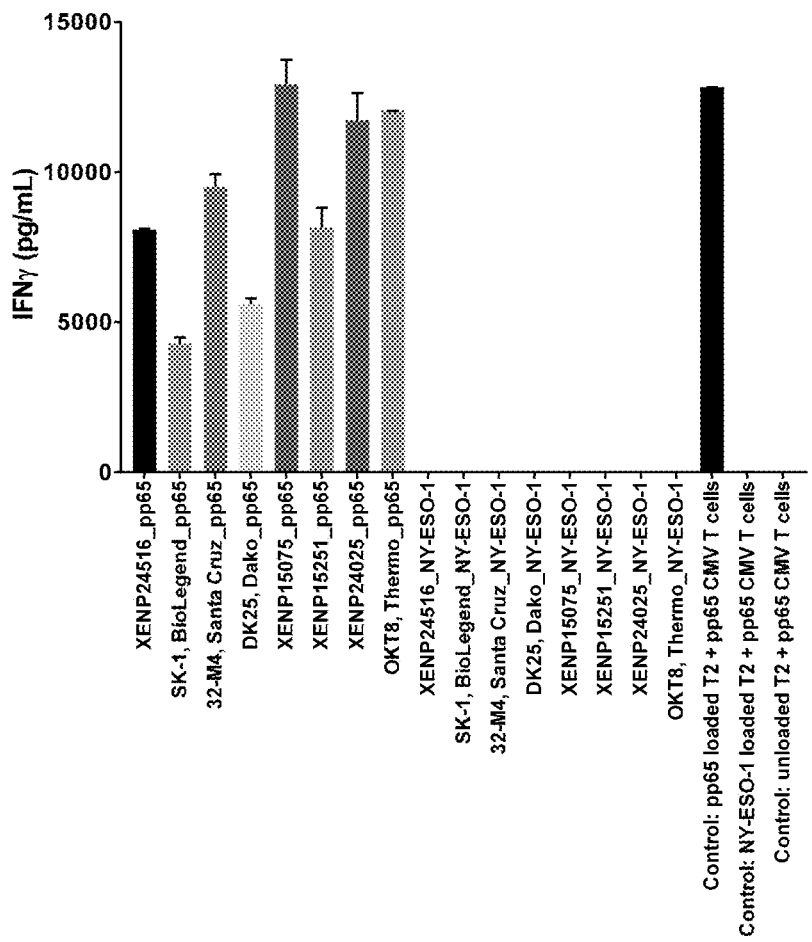

FIG. 85 depicts IFNγ release by T cells specific for HLA2:01 restricted pp65 (NLVPMVATV) peptide (SEQ ID NO: 6) (pre-incubated with various anti-CD8 antibodies) following incubation with T2 cells loaded with HLA-A2*0201 restricted CMV pp65 (NLVPMVATV) peptide (SEQ ID NO: 6) or NY-ESO-1 peptide.

Figure 86:
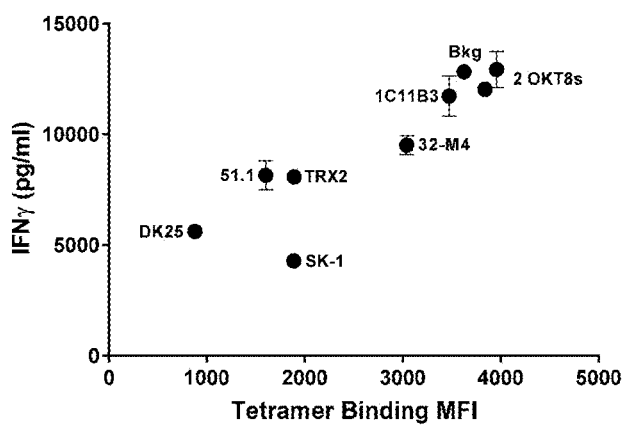

FIG. 86 depicts the correlation between IFNγ release and tetramer binding by T cells.

FIG. 87 depicts sequences for XENP24736, an illustrative CD8-targeted IL-15/Rα-Fc fusion with anti-CD8 Fab arm based on phage-derived 1C11B3. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

Figure 88A:
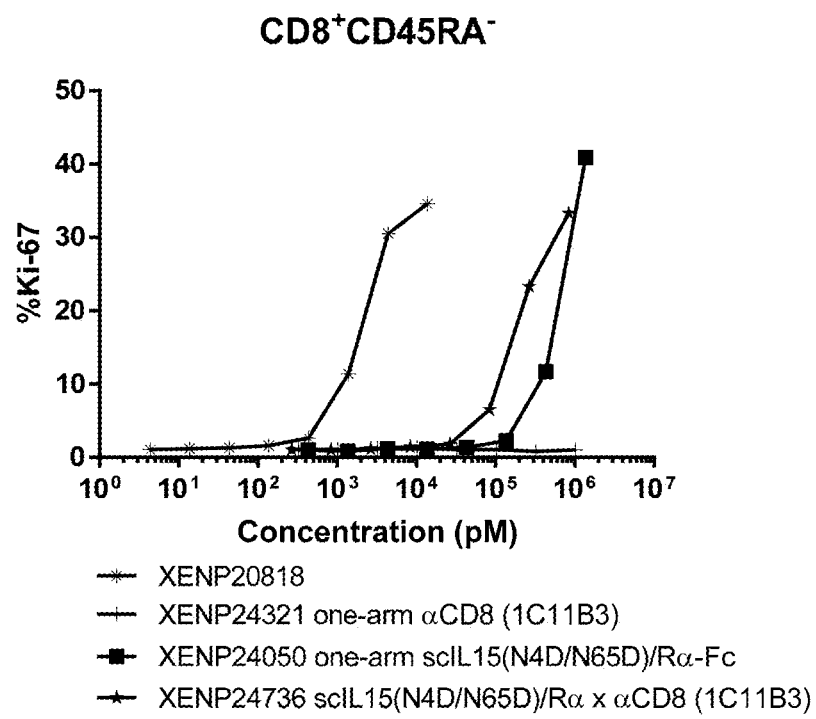
Figure 88B:
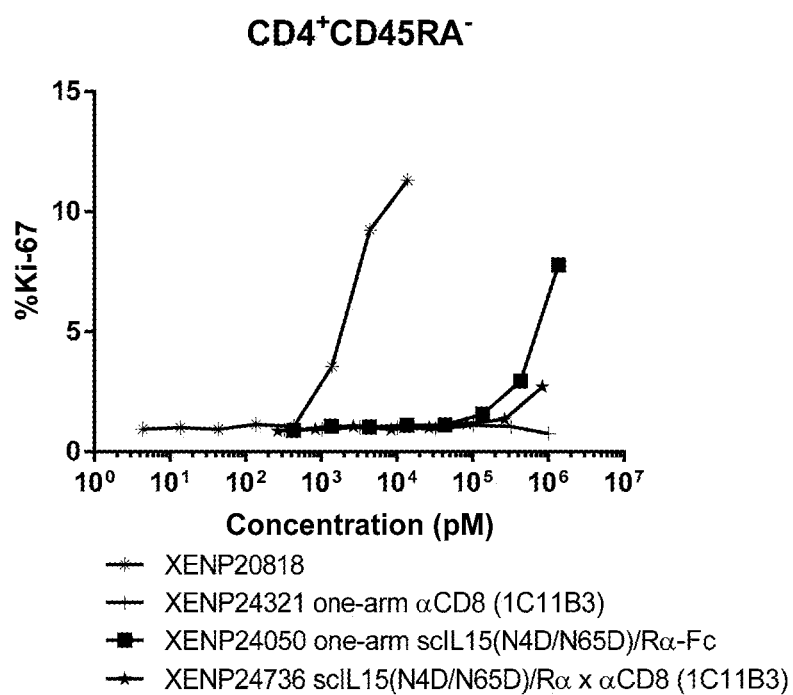

FIG. 88A-FIG. 88B depict percentage of (FIG. 88A) CD8+CD45RA− T cells and (FIG. 88B) CD4+CD45RA− T cells expressing Ki67 in human PBMCs treated with indicated test articles.

FIG. 89 depicts OKT8 variable regions, murine or humanized as indicated. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 90 depicts the sequences for XENP15075, a humanized anti-OKT8 mAb. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 91 depicts an illustrative one-arm anti-CD8 mAb with Fab arms based on humanized OKT8 variable regions as depicted in FIG. 89. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 92A-FIG. 92C depict illustrative CD8-targeted IL-15/Rα-Fc fusions with anti-CD8 Fab arms based on murine or humanized OKT8 variable regions as depicted in FIG. 89. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIG. 6 and FIG. 7), and slashes (/) indicate the border(s) between IL-15, IL-15Rα, linkers, variable regions, and constant/Fc regions.

Figure 93A:
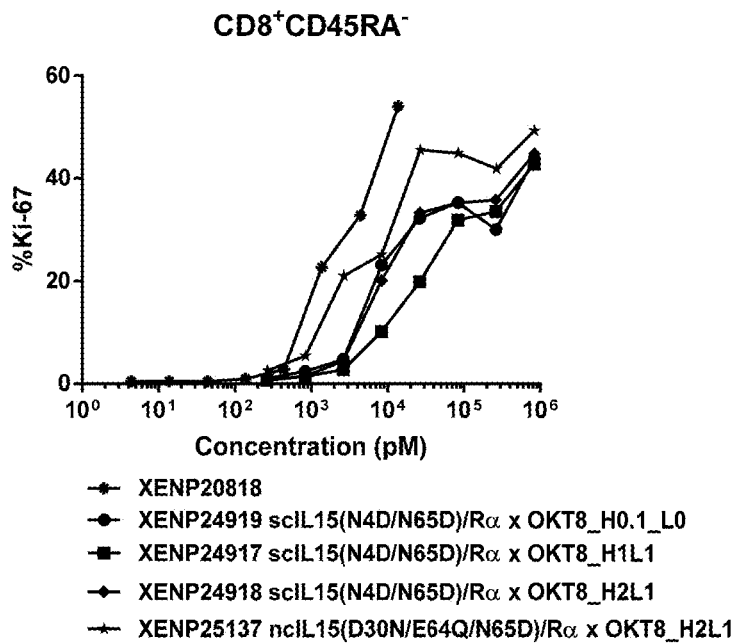
Figure 93B:
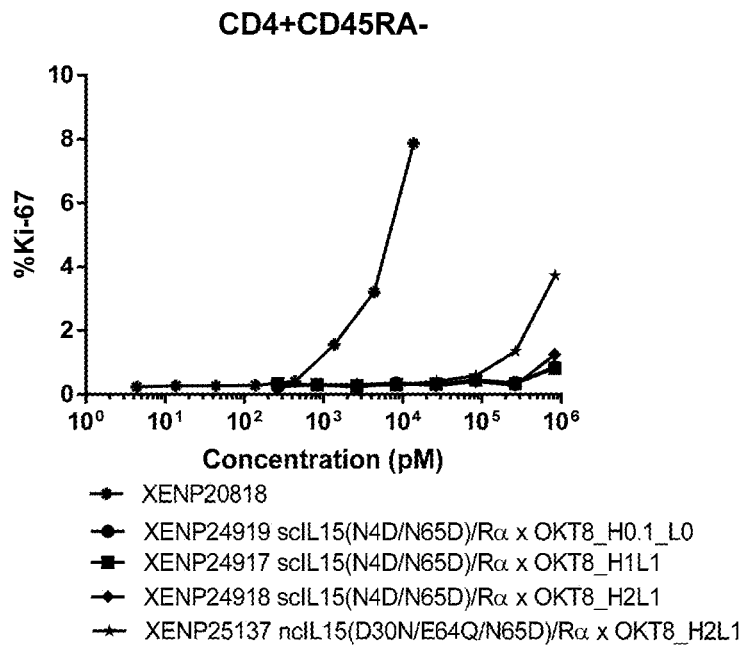

FIG. 93A-FIG. 93B depict percentage of (FIG. 93A) CD8+CD45RA− T cells and (FIG. 93B) CD4+CD45RA− T cells expressing Ki67 in human PBMCs treated with CD8-targeted IL-15/Rα-Fc fusions with humanized OKT8 binding domain.

Figure 94A:
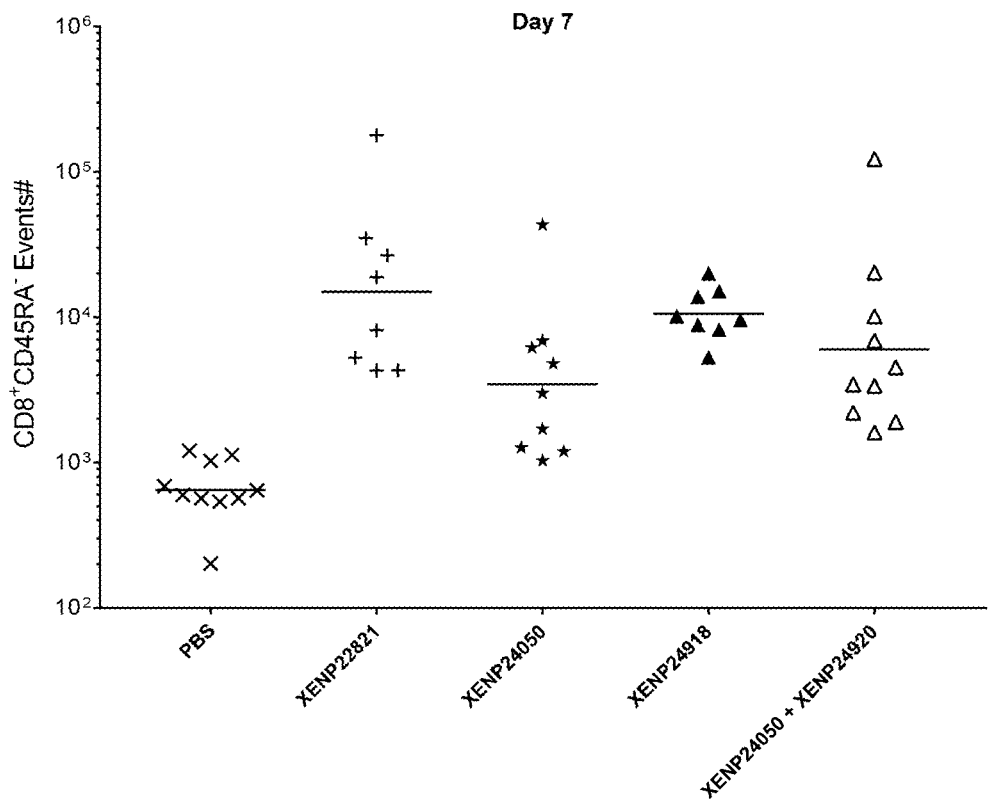
Figure 94B:
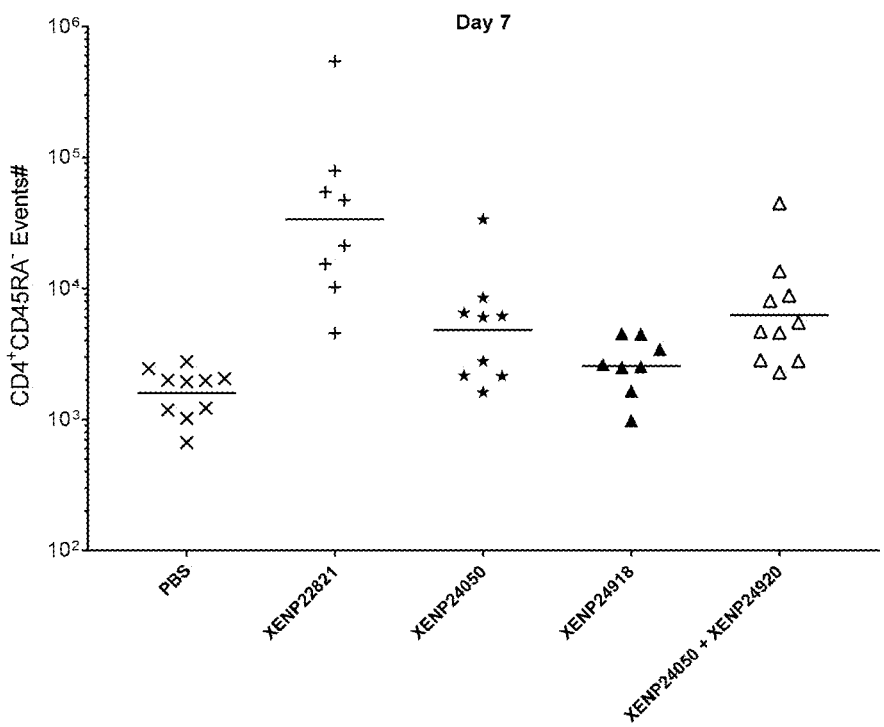
Figure 94C:
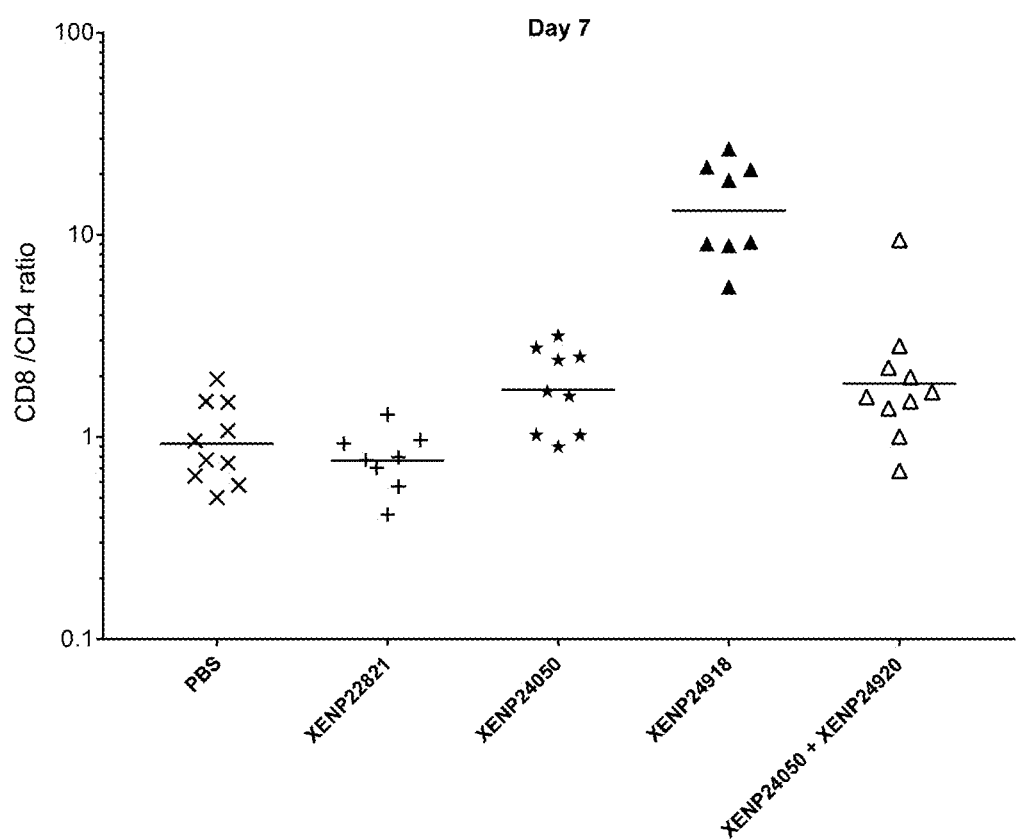

FIG. 94A-FIG. 94C depict (FIG. 94A) CD8+CD45RA− T cell counts, (FIG. 94B) CD4+CD45RA− T cell counts, and (FIG. 94C) CD8+/CD4+ T cell ratio in blood of human PBMC-engrafted NSG-mice on Day 7.

FIG. 95A-FIG. 95B depict variant variable heavy regions based on OKT8_H2 (Humanized Variable Heavy V2) as depicted in FIG. 89 and variant variable light regions based on OKT8_H1 (Humanized Variable Light V1) as depicted in FIG. 89. Each of the variable heavy regions depicted herein may be combined with any of the variable light regions depicted in this Figure as well as those depicted in FIG. 89. Each of the variable light regions depicted herein may be combined with any of the variable heavy regions depicted in this Figure as well as those depicted in FIG. 89. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Furthermore, as for all the sequences in the Figures, these VH and VL sequences can be used either in a scFv format or in a Fab format.

FIG. 96 depicts the dissociation constant ($K_D$), dissociation rate ($k_d$), and association rate ($k_a$) of illustrative cyno CD8 affinity engineered OKT8_H2L1 for human and cyno CD8. The molecules depicted here are one-arm mAbs using having an empty-Fc and a Fab, wherein the Fab arms comprise variable regions as depicted in FIGS. 89 and 95. For example, the Fab arm of XENP26009 has OKT8_H2.152 Variable Heavy and OKT8_L1.103 Variable Light.

FIG. 97A-FIG. 97B depict illustrative CD8-targeted IL-15/Rα-Fc fusions with anti-CD8 Fab arms based on cyno-affinity engineered (HuCy) OKT8 variable regions as depicted in FIG. 95. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

Figure 98A:
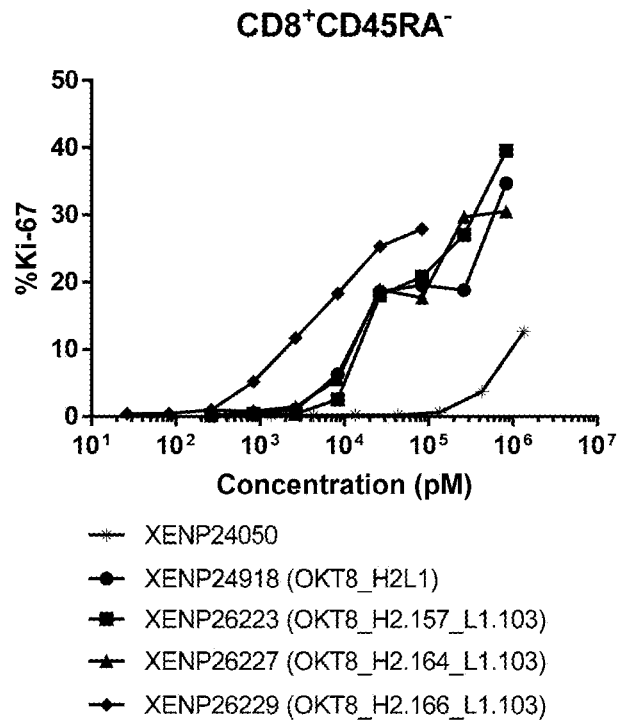
Figure 98B:
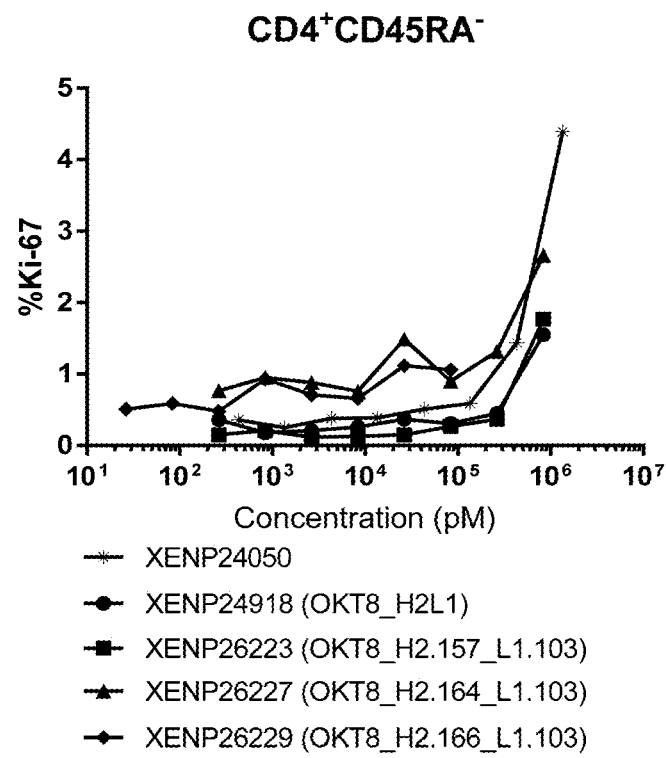

FIG. 98A-FIG. 98B depict percentage of (FIG. 98A) CD8+CD45RA-T cells and (FIG. 98B) CD4+CD45RA⁻ T cells expressing Ki67 in human PBMCs treated with CD8-targeted IL-15/Rα-Fc fusions with cyno affinity-engineered humanized OKT8 binding domains.

Figure 99A:
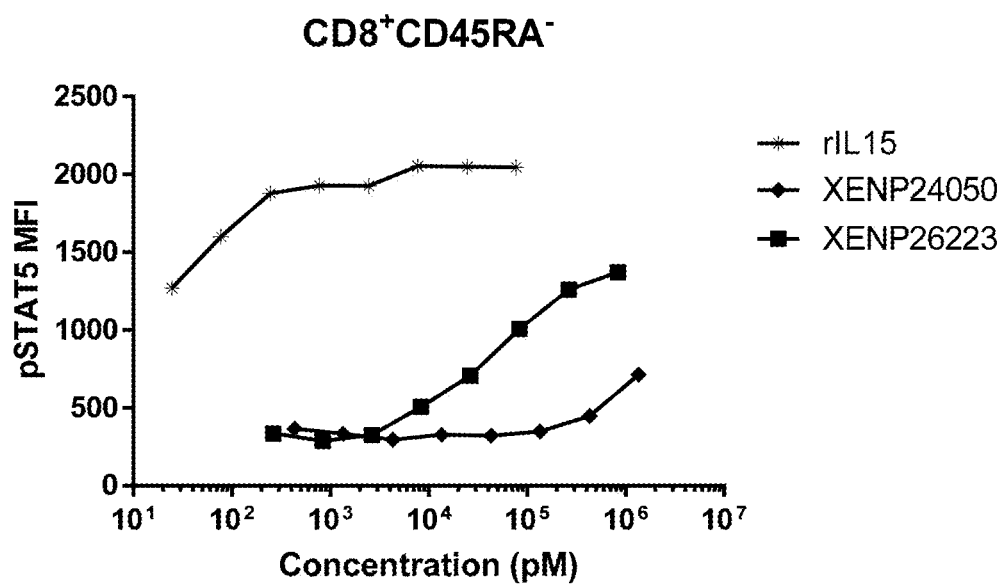
Figure 99B:
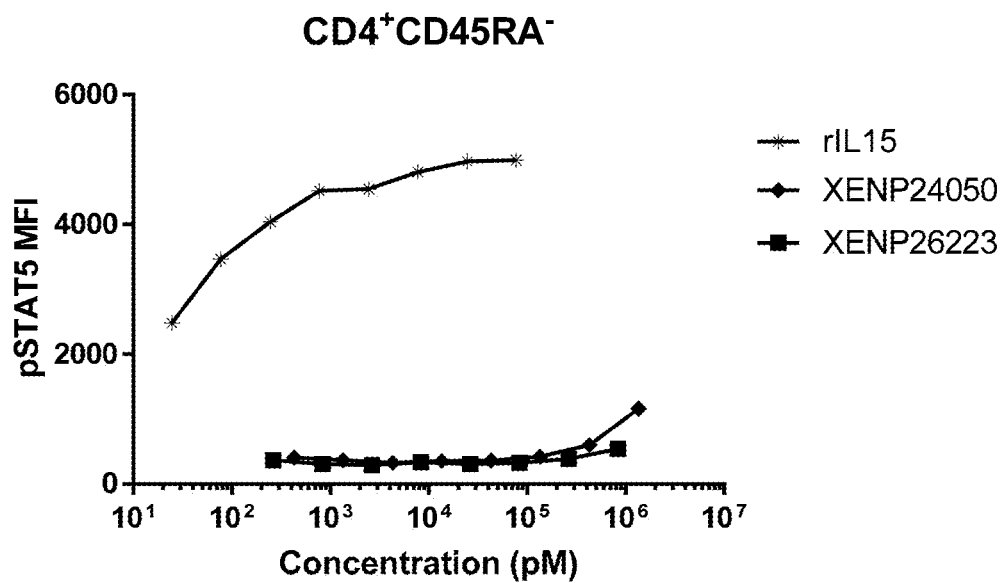
Figure 100A:
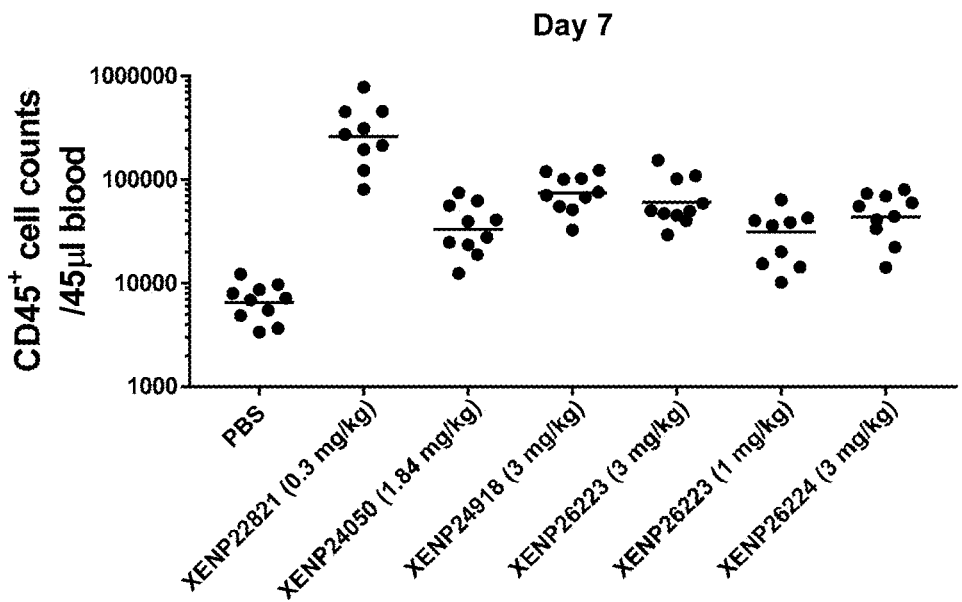
Figure 100B:
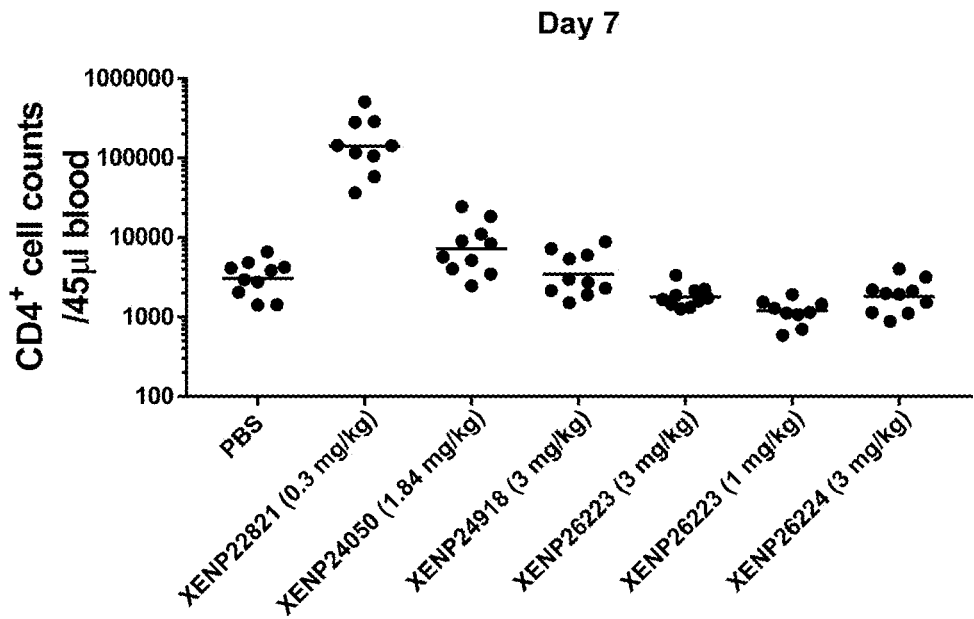
Figure 100C:
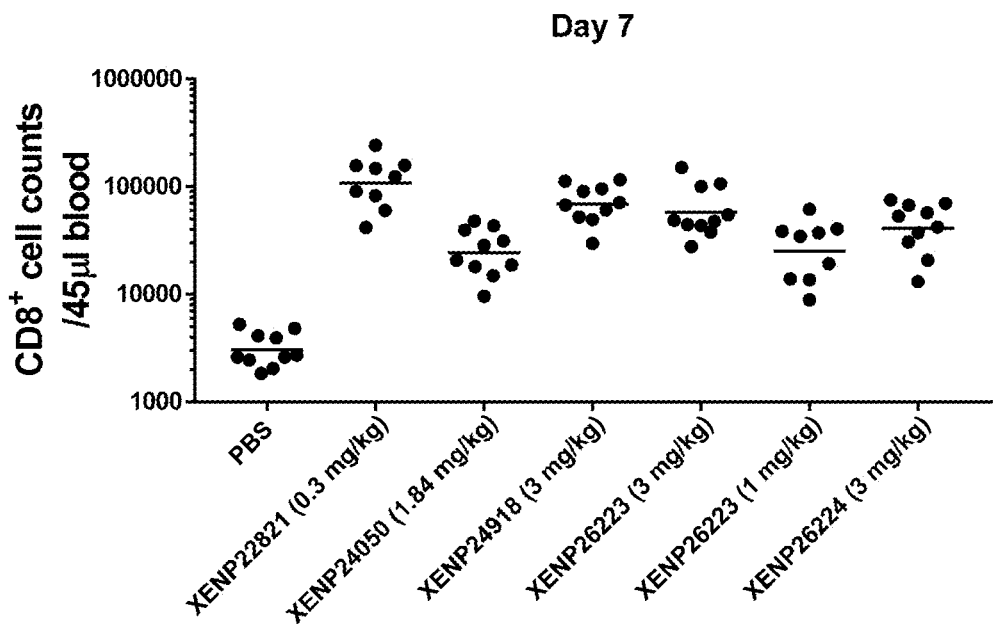
Figure 100D:
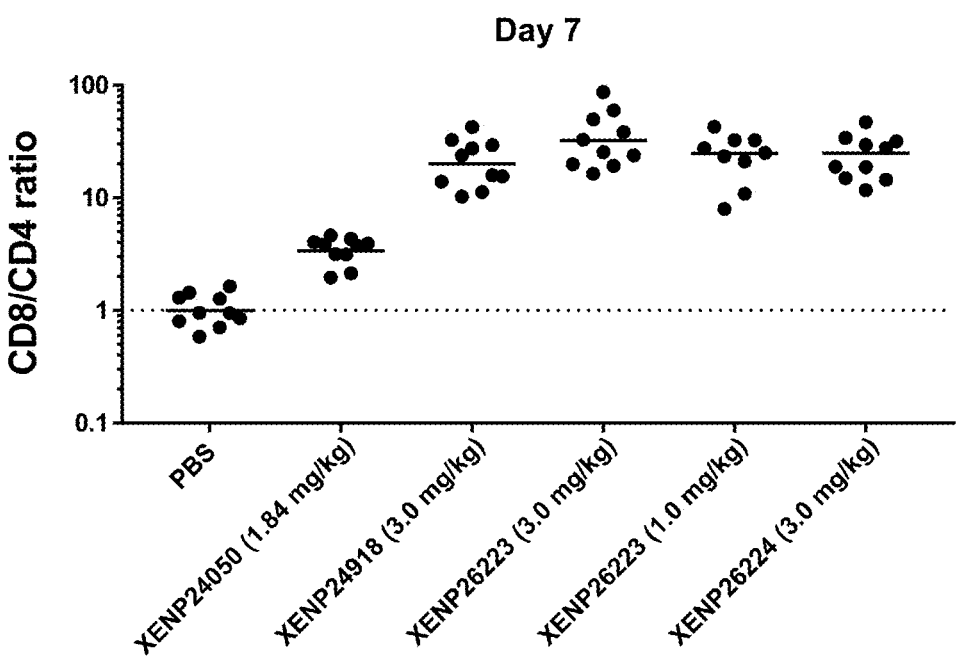

FIG. 99A-FIG. 99B depict STAT5 phosphorylation on (FIG. 99A) CD8+CD45RA⁻ T cells and (FIG. 99B) CD4+CD45RA⁻ T cells in human PBMCs treated with CD8-targeted IL-15/Rα-Fc fusions with cyno affinity-engineered humanized OKT8 binding domains.

FIG. 100A-FIG. 100D depict (FIG. 100A) CD45⁺ cell count, (FIG. 100B) CD4⁺ T cell count, (FIG. 100C) CD8⁺ T cell count, and (FIG. 100D) CD8+/CD4⁺ T cell ratio in blood of human PBMC-engrafted NSG mice on Day 7 after dosing with CD8-targeted IL-15/Rα-Fc fusions with cyno affinity-engineered humanized OKT8 binding domains.

Figure 101A:
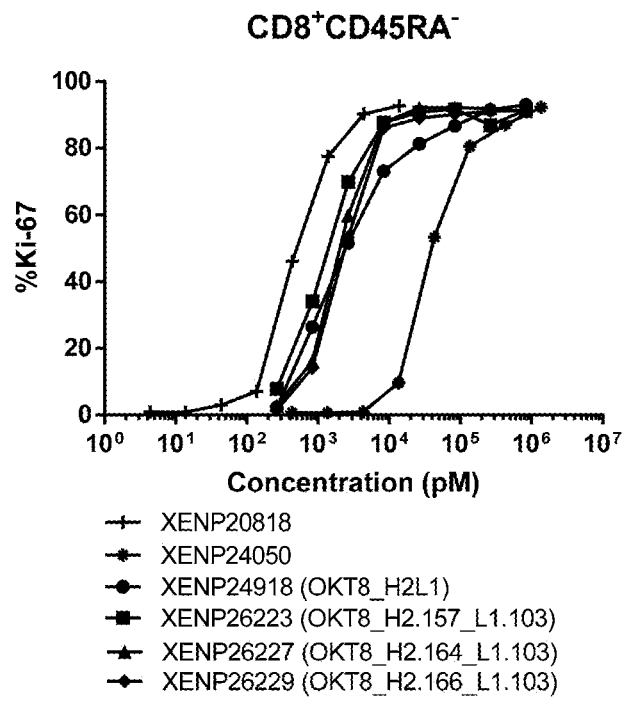
Figure 101B:
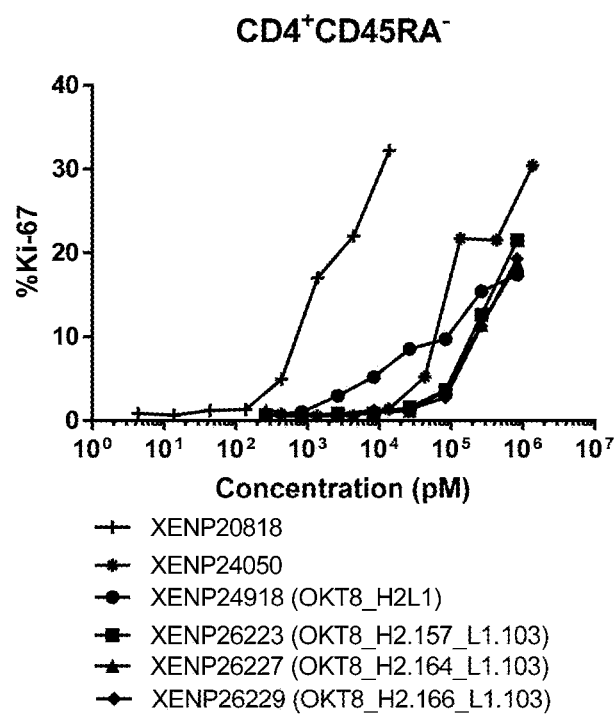
Figure 103A:
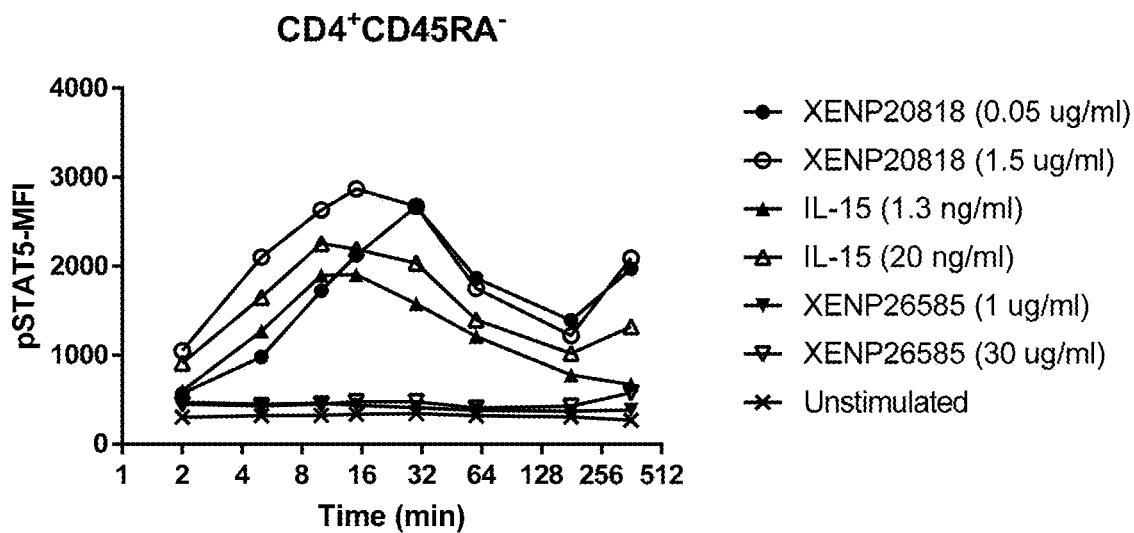
Figure 103B:
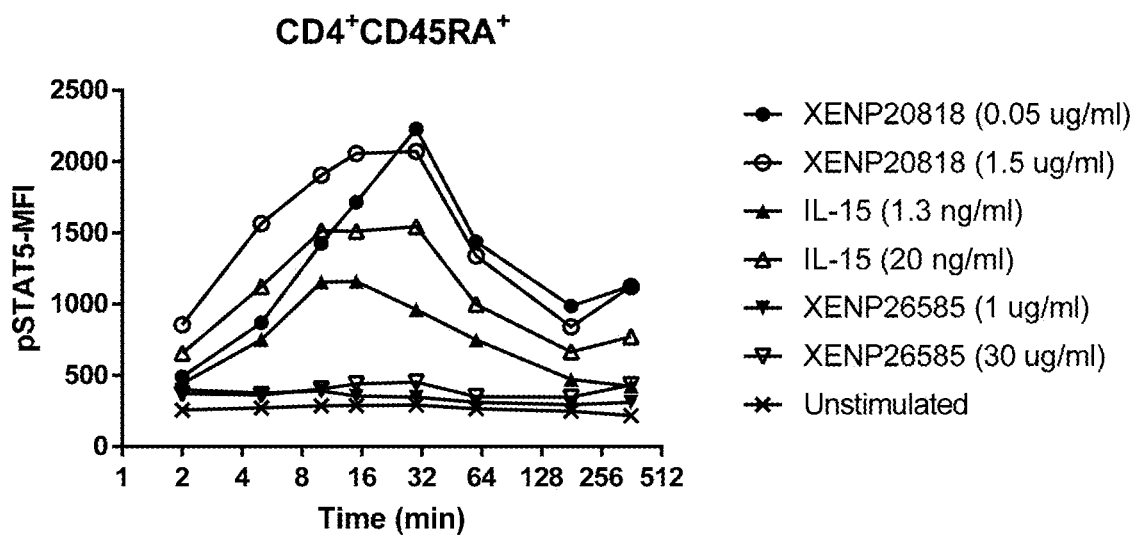
Figure 103C:
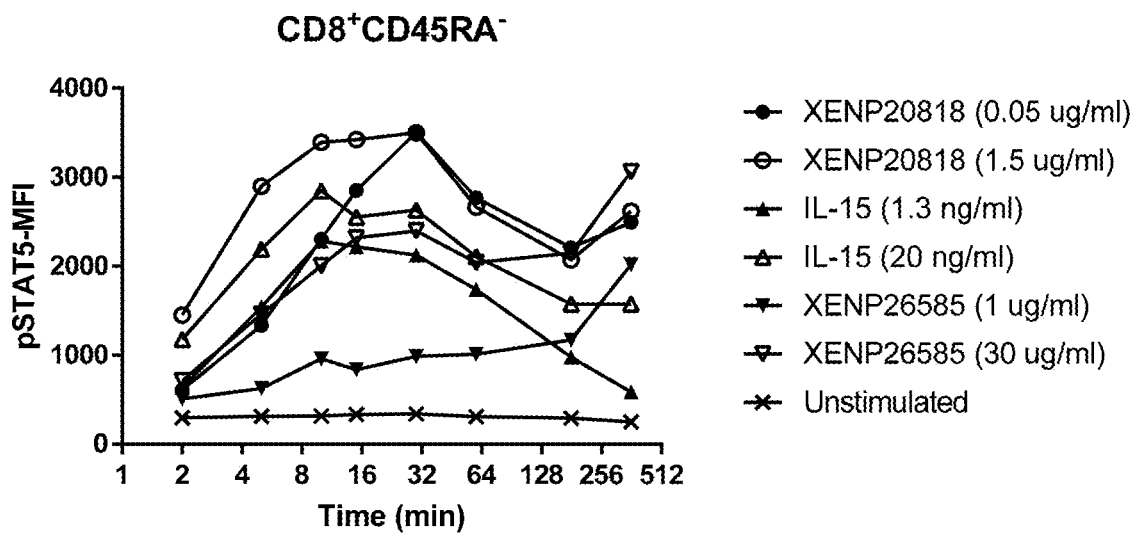
Figure 103D:
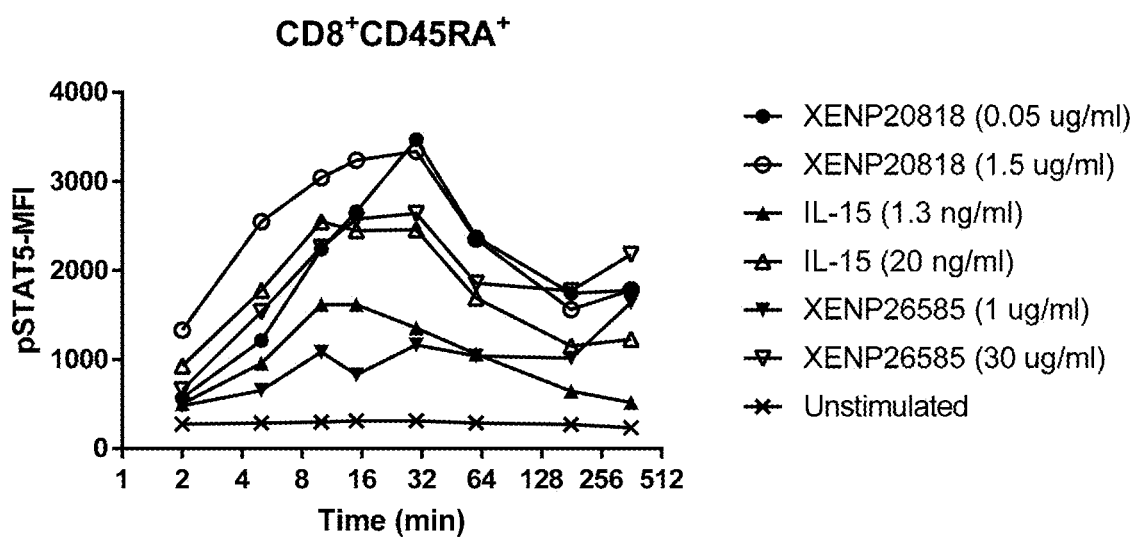
Figure 103E:
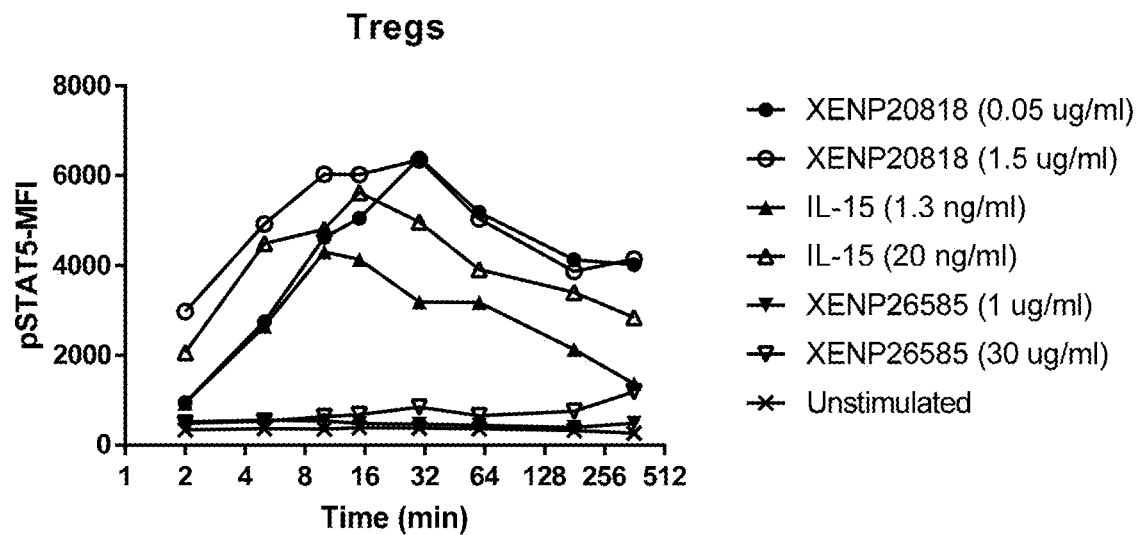
Figure 103F:
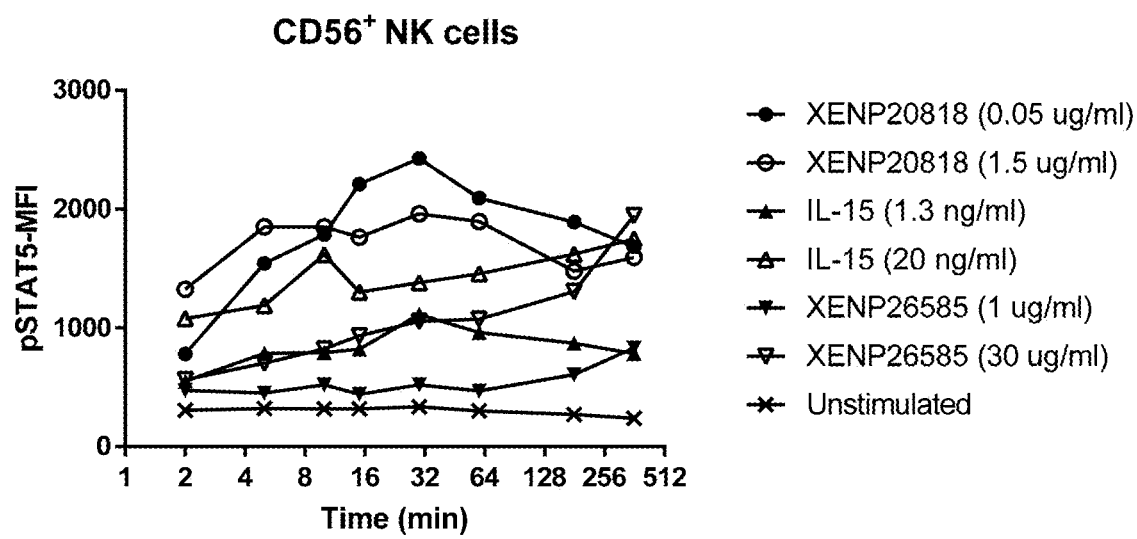

FIG. 101A-FIG. 101B depict percentage of A) CD8⁺ CD45RA⁻ T cells and B) CD4⁺CD45RA⁻ T cells expressing Ki67 in cynomolgus PBMCs treated with CD8-targeted IL-15/Rα-Fc fusions with cyno affinity-engineered humanized OKT8 binding domains.

FIG. 102 depicts an illustrative CD8-targeted IL-15/Rα-Fc fusion with Xtend Fc. The CDRs are in bold. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. IL-15 and IL-15Rα(sushi) are underlined, linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions.

FIG. 103A-FIG. 103F depict STAT5 phosphorylation on A) CD4+CD45RA- T cell, B) CD4+CD45RA+ T cell, C) CD8+CD45RA- T cell, D) CD8+CD45RA+ T cell, E) Tregs, and F) CD56- NK cells, over time by various concentrations of recombinant IL-15, WT IL-15/Rα-Fc (XENP20818), and illustrative CD8-targeted IL-15/Rα-Fc fusion (XENP26585).

Figure 104A:
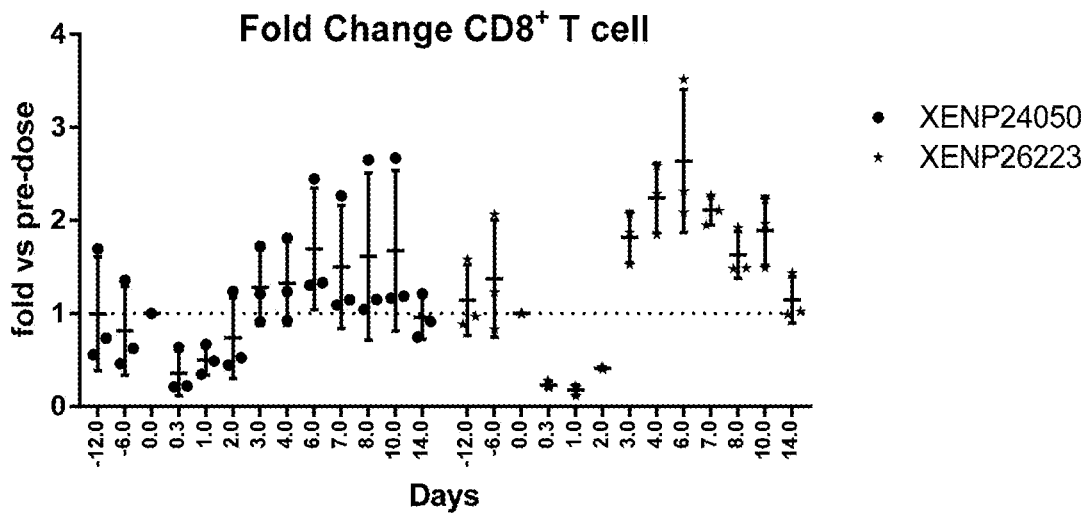
Figure 104B:
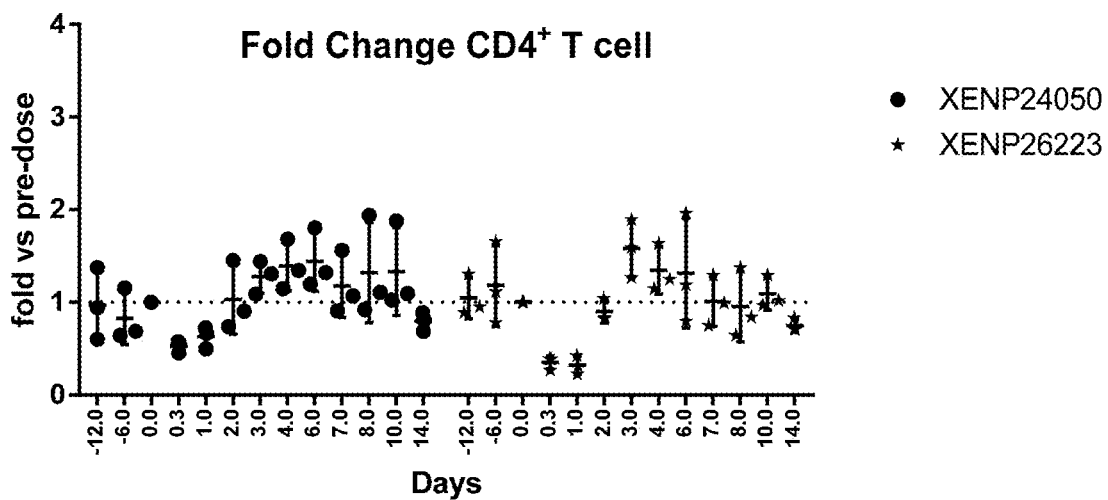

FIG. 104A-FIG. 104B depict fold change over time in A) CD8+ T cell and B) CD4+ T cell counts in cynomolgus peripheral blood following dosing with XENP24050 or XENP26223.

Figure 105A:
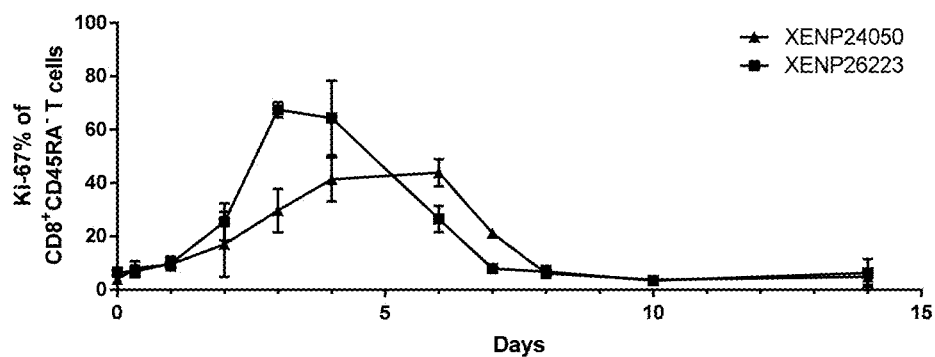
Figure 105B:
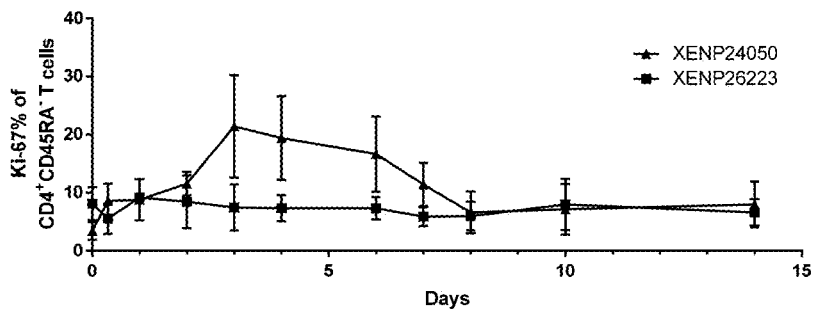

FIG. 105A-FIG. 105B depict percentage of A) CD8+ T cell and B) CD4+ T cell expressing Ki67 in cynomolgus peripheral blood following dosing with XENP24050 or XENP26223.

Figure 106:
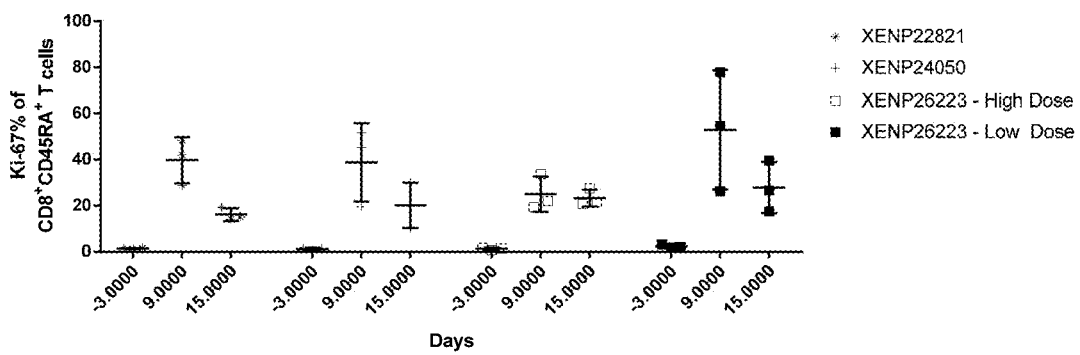

FIG. 106 depicts percentage of CD8+CD45RA⁻ T cells expressing Ki67 in cynomolgus lymph nodes following dosing with XENP24050 or XENP26223.

Figure 107A:
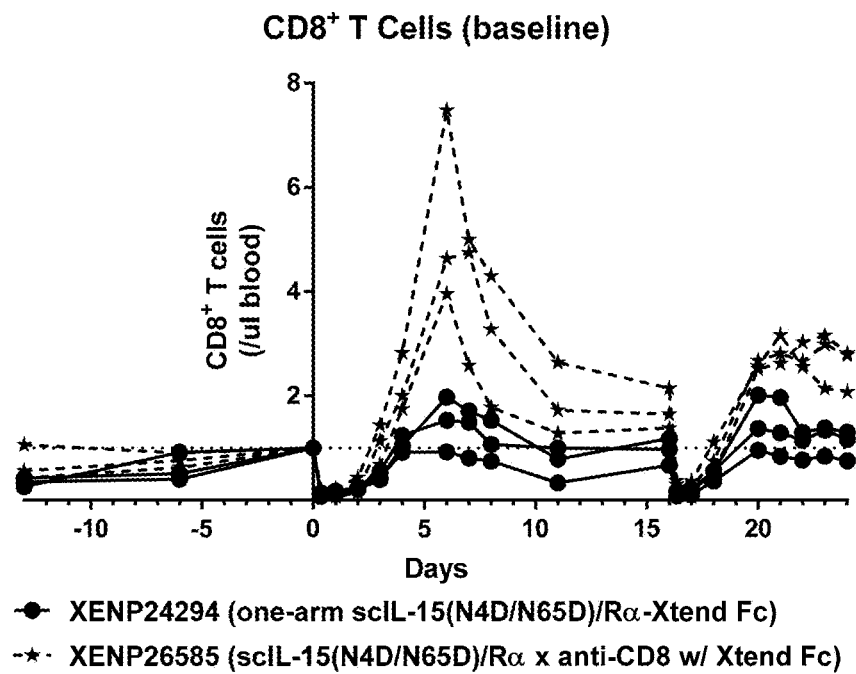
Figure 107B:
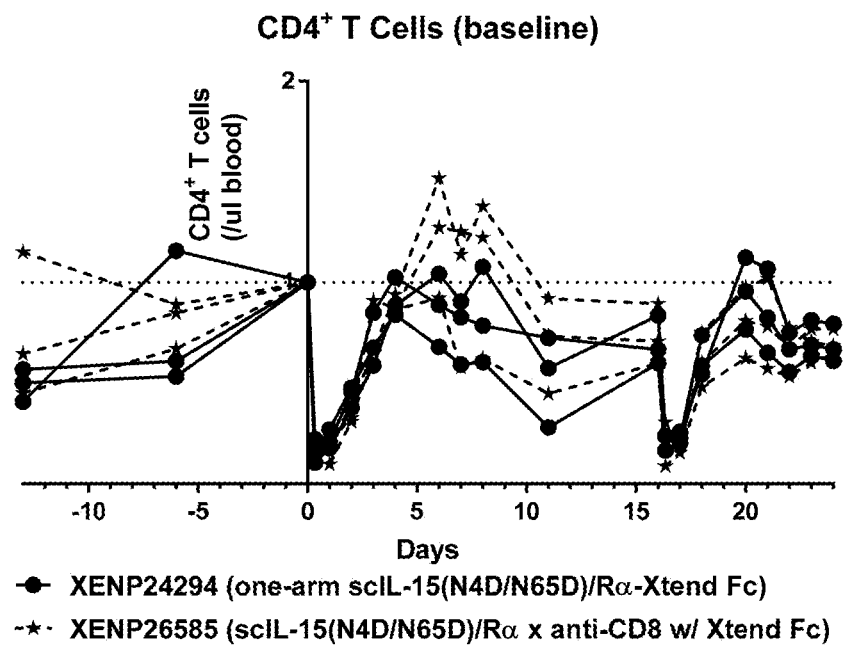
Figure 107C:
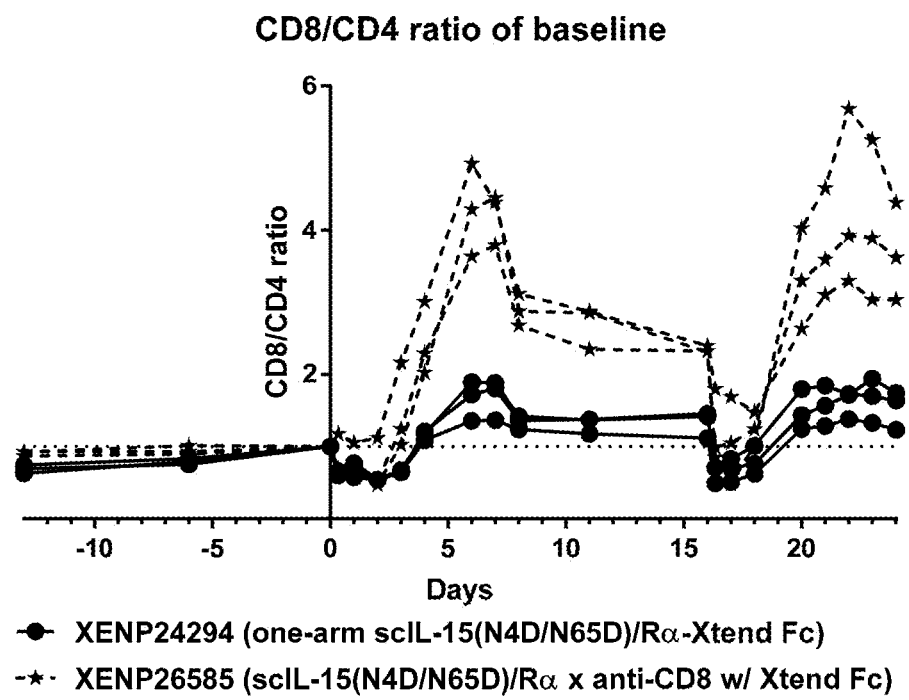

FIG. 107A-FIG. 107C depict A) CD8+ T cell counts, B) CD4+ T cell counts, and C) CD8+/CD4+ T cell ratio following dosing with one-arm reduced potency IL-15/Rα-Fc Fusion with Xtend Fc (XENP24294) and CD8-targeted IL-15/Rα-Fc fusion with Xtend Fc (XENP26585).

Figure 108A:
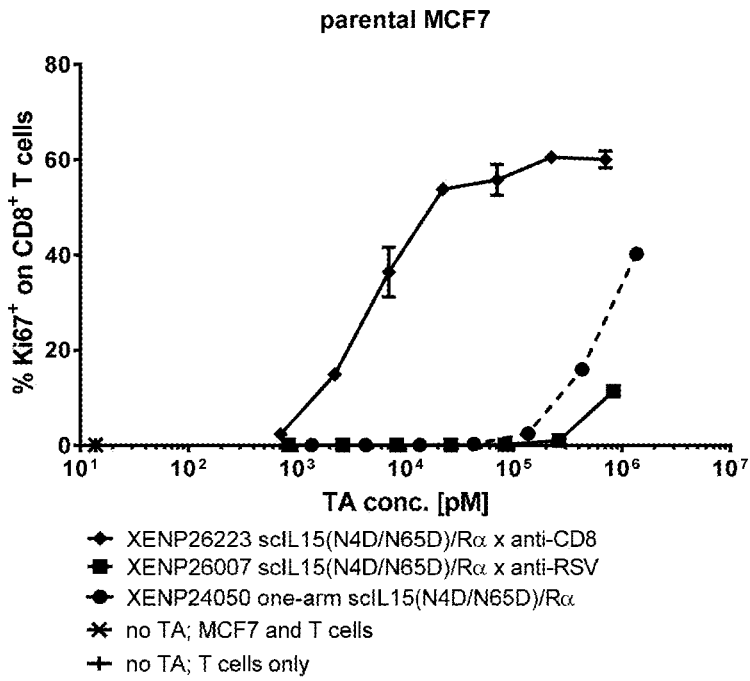
Figure 108B:
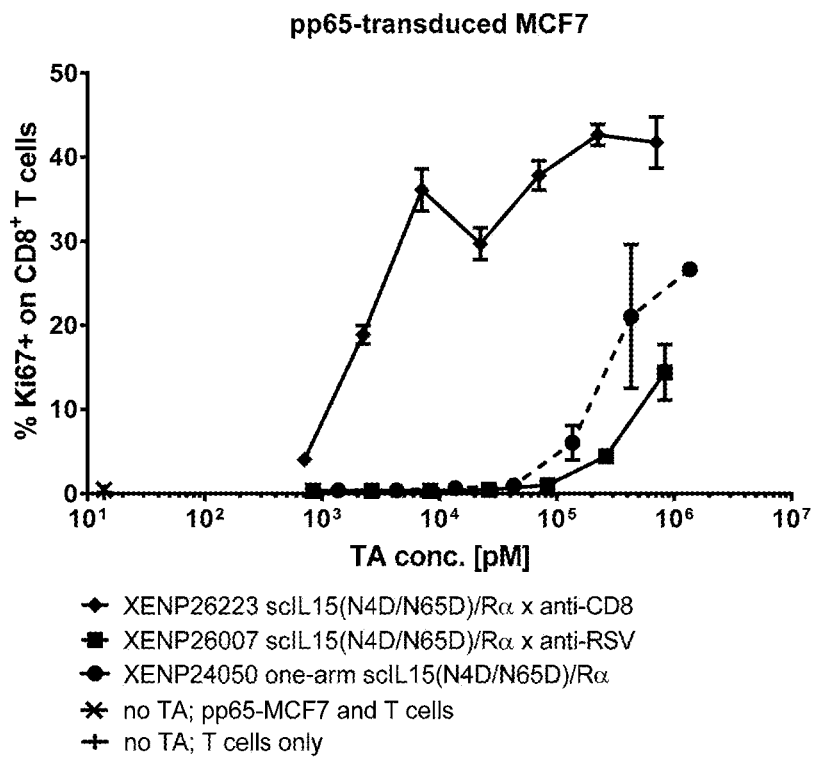

FIG. 108A-FIG. 108B depict percentage of CD8+ T cells positive for Ki67 in (FIG. 108A) Group 1 (purified T cells incubated with parental MCF-7 tumor cells and indicated test articles) and (FIG. 108B) Group 2 (purified T cells incubated with pp65-expressing MCF-7 tumor cells and indicated test articles).

Figure 109A:
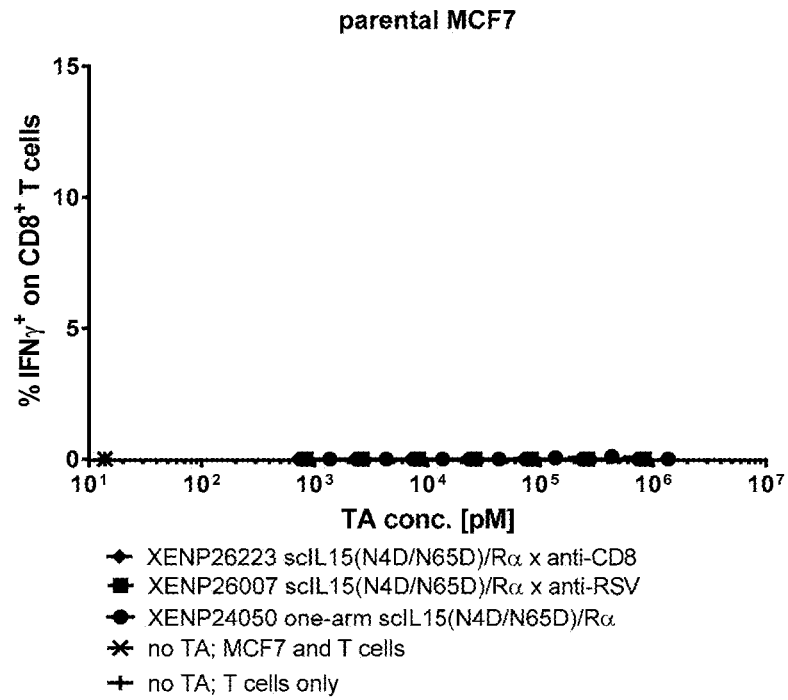
Figure 109B:
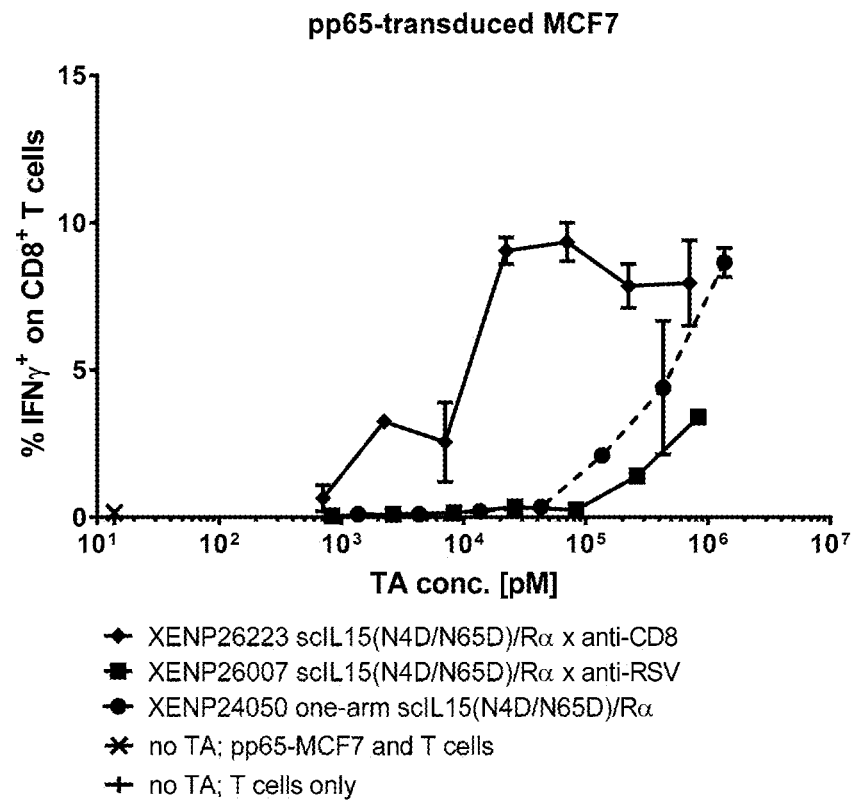

FIG. 109A-FIG. 109B depict percentage of CD8+ T cells positive for IFNγ in (FIG. 109A) Group 1 (purified T cells incubated with parental MCF-7 tumor cells and indicated test articles) and (FIG. 109B) Group 2 (purified T cells incubated with pp65-expressing MCF-7 tumor cells and indicated test articles).

Figure 110A:
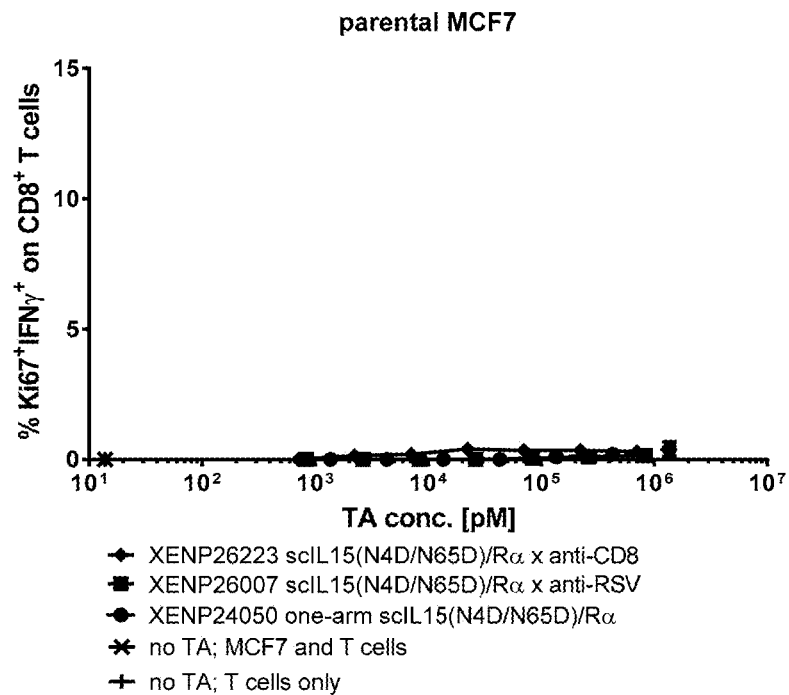
Figure 110B:
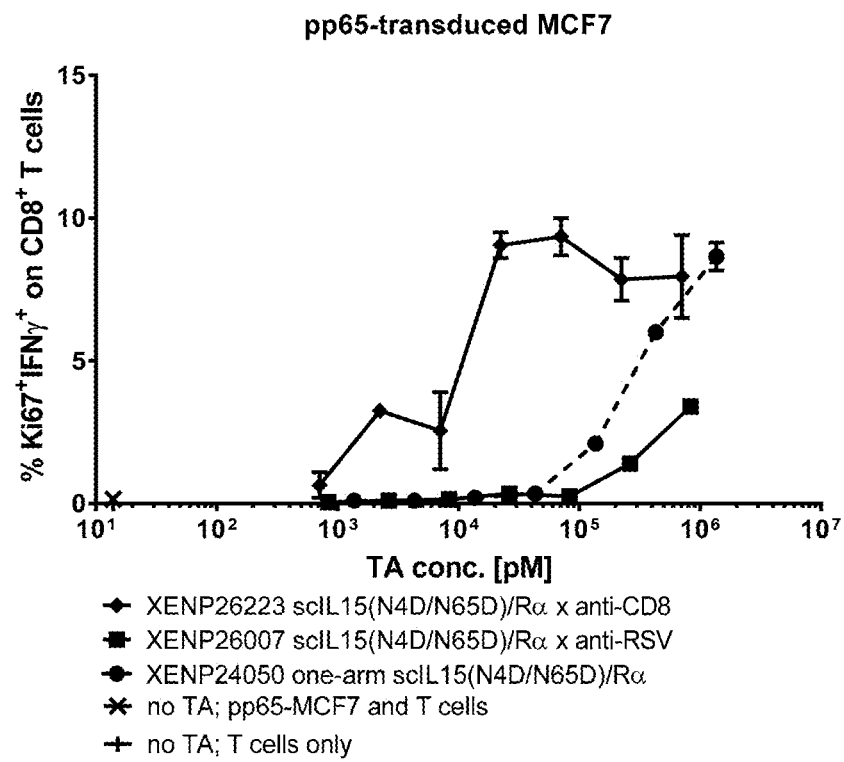

FIG. 110A-FIG. 110B depict percentage of CD8+ T cells positive for Ki67 and IFNγ in (FIG. 110A) Group 1 (purified T cells incubated with parental MCF-7 tumor cells and indicated test articles) and (FIG. 110B) Group 2 (purified T cells incubated with pp65-expressing MCF-7 tumor cells and indicated test articles).

Figure 111A:
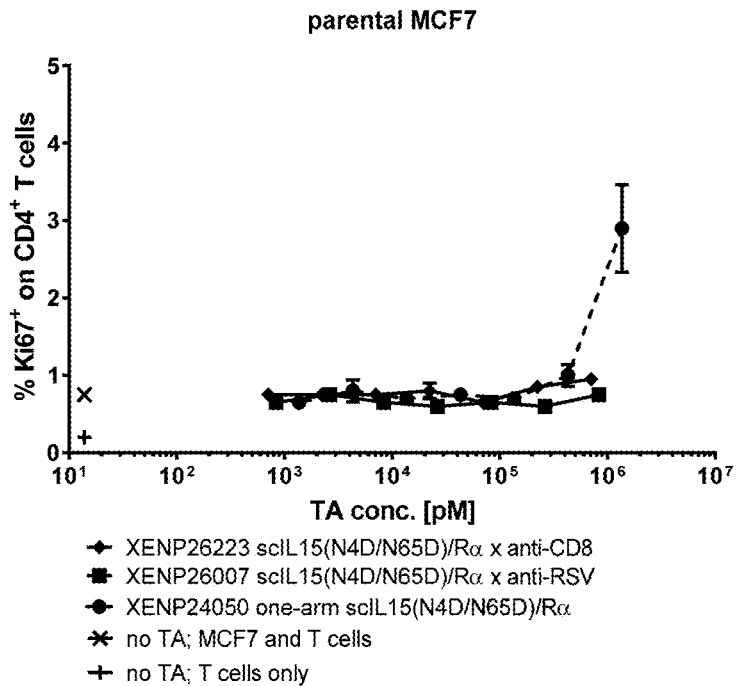
Figure 111B:
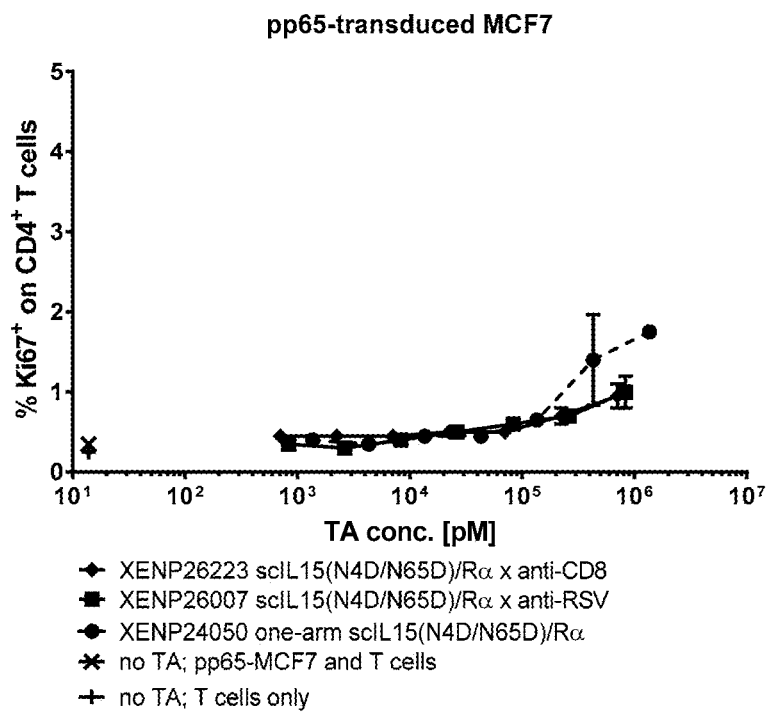

FIG. 111A-FIG. 111B depict percentage of CD4⁺ T cells positive for Ki67 in (FIG. 111A) Group 1 (purified T cells incubated with parental MCF-7 tumor cells and indicated test articles) and (FIG. 111B) Group 2 (purified T cells incubated with pp65-expressing MCF-7 tumor cells and indicated test articles).

Figure 112A:
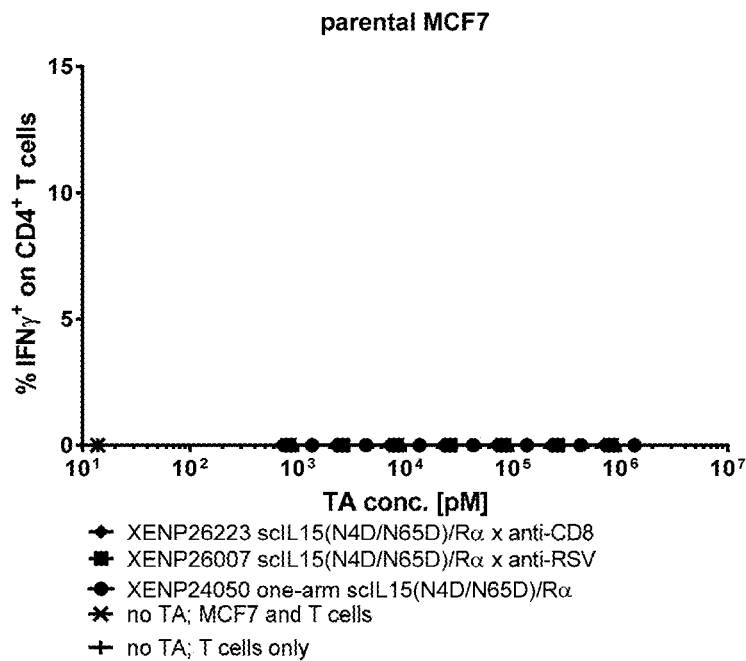
Figure 112B:
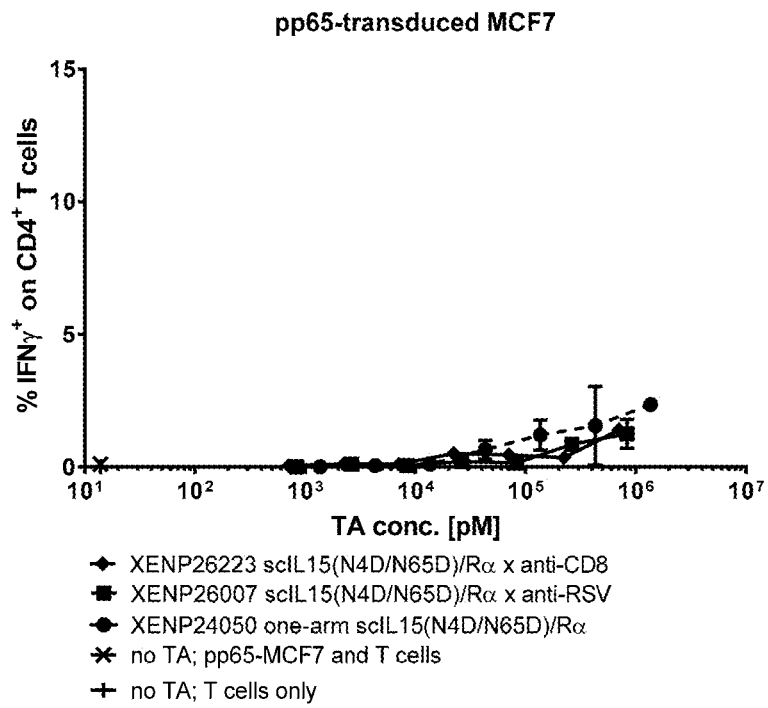

FIG. 112A-FIG. 112B depict percentage of CD4+ T cells positive for IFNγ in (FIG. 112A) Group 1 (purified T cells incubated with parental MCF-7 tumor cells and indicated test articles) and (FIG. 112B) Group 2 (purified T cells incubated with pp65-expressing MCF-7 tumor cells and indicated test articles).

Figure 113A:
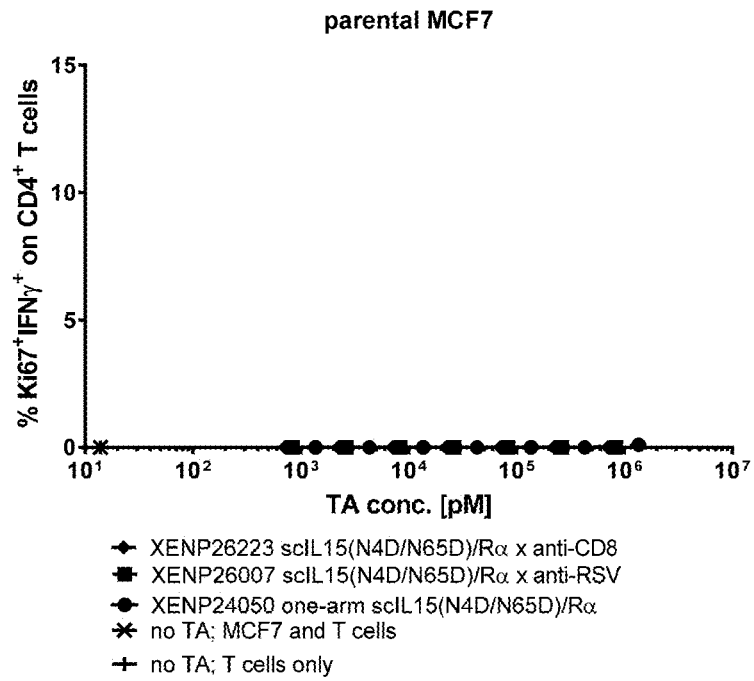
Figure 113B:
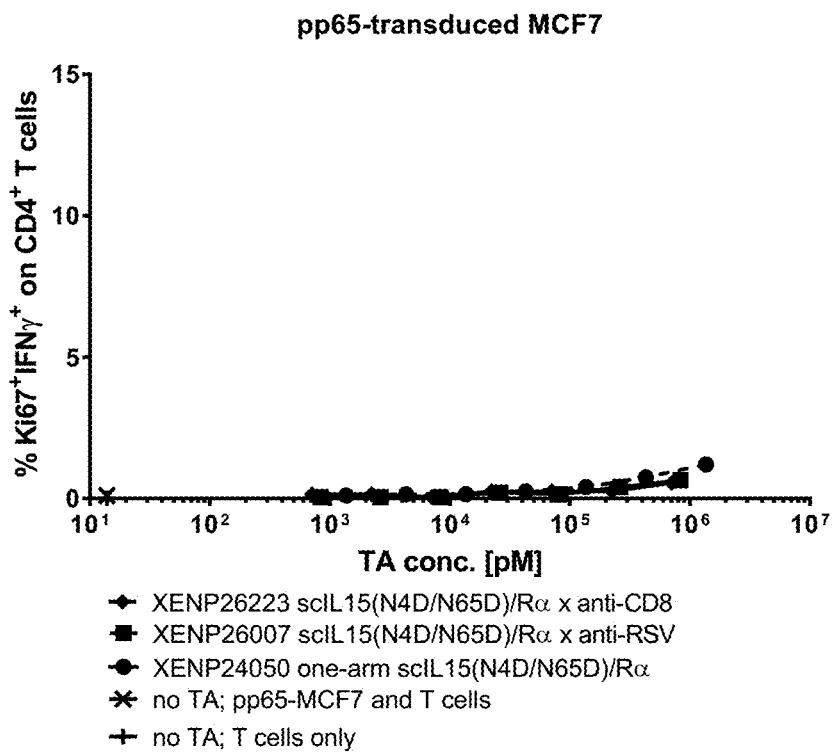

FIG. 113A-FIG. 113B depict percentage of CD4+ T cells positive for Ki67 and IFNγ in (FIG. 113A) Group 1 (purified T cells incubated with parental MCF-7 tumor cells and indicated test articles) and (FIG. 113B) Group 2 (purified T cells incubated with pp65-expressing MCF-7 tumor cells and indicated test articles).

Figure 114A:
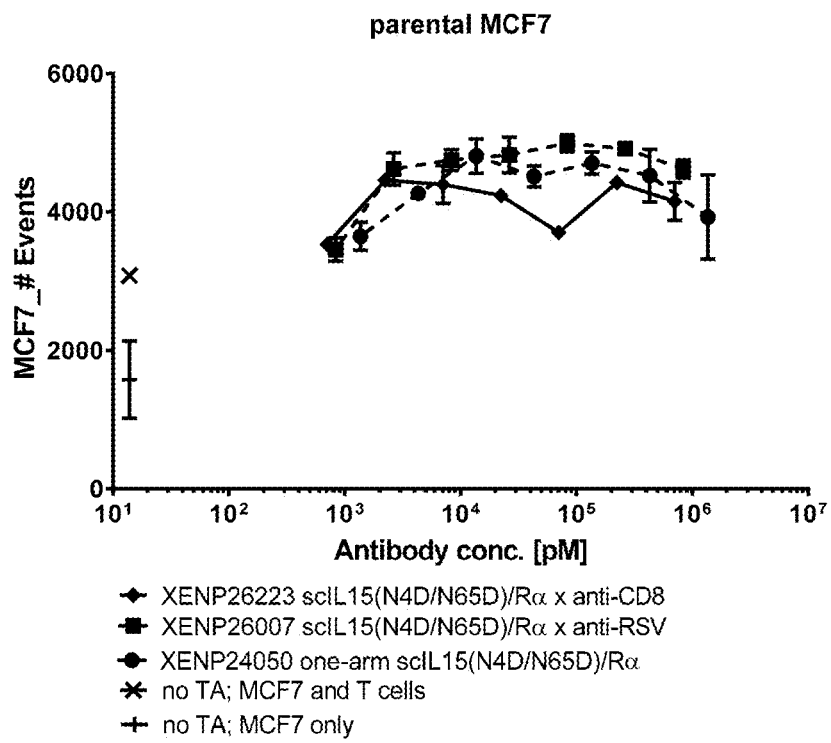
Figure 114B:
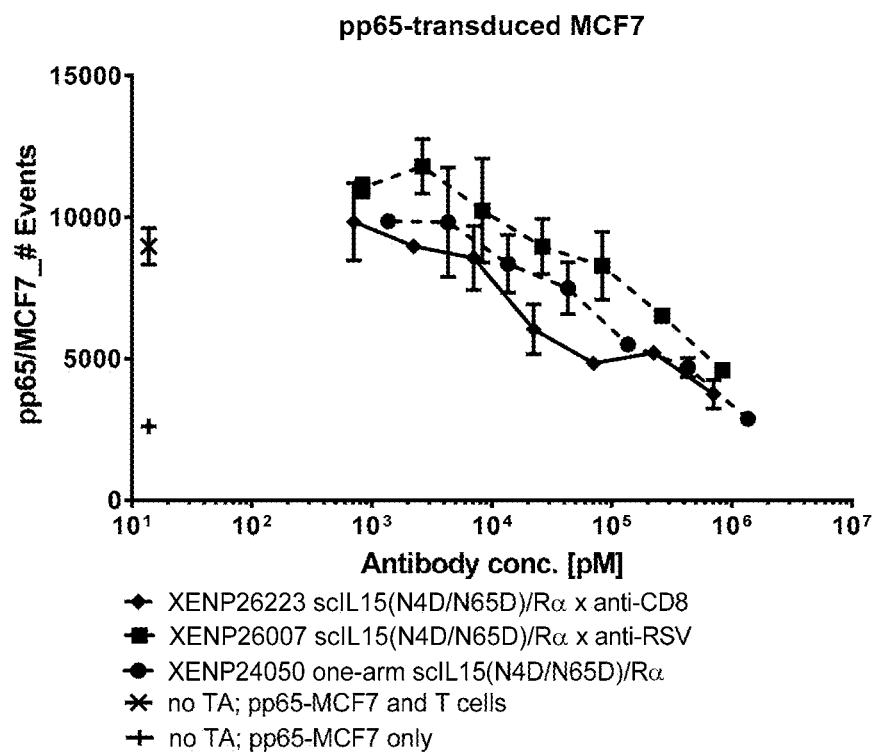

FIG. 114A-FIG. 114B depict remaining target cells [FIG. 114A: parental MCF-7 tumor cells; FIG. 114B: pp65-expressing MCF-7 tumor cells] following incubation with purified T cells and indicated test articles.

Figure 115A:
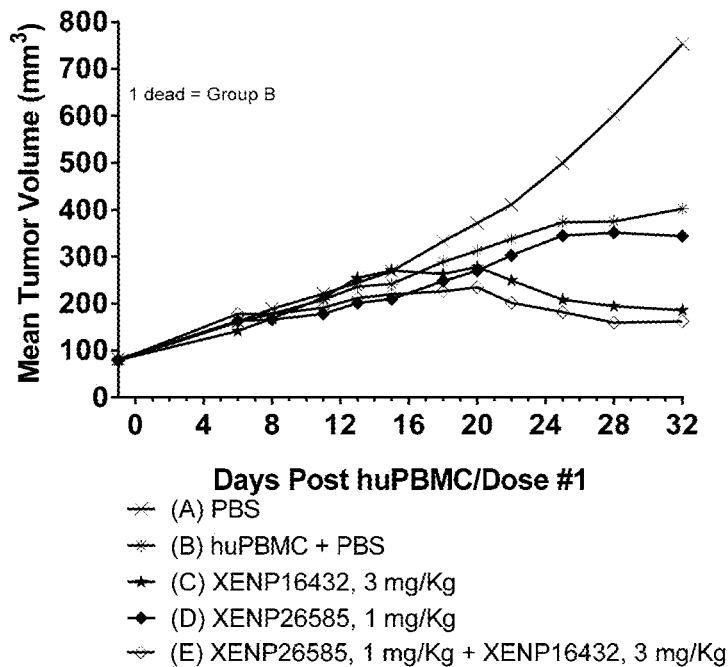
Figure 115B:
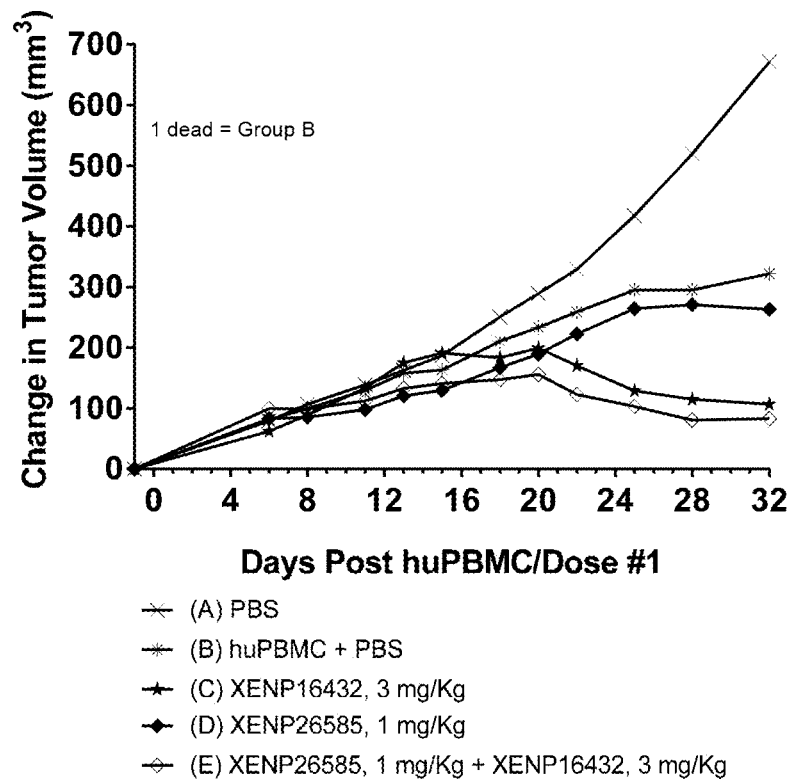
Figure 116A:
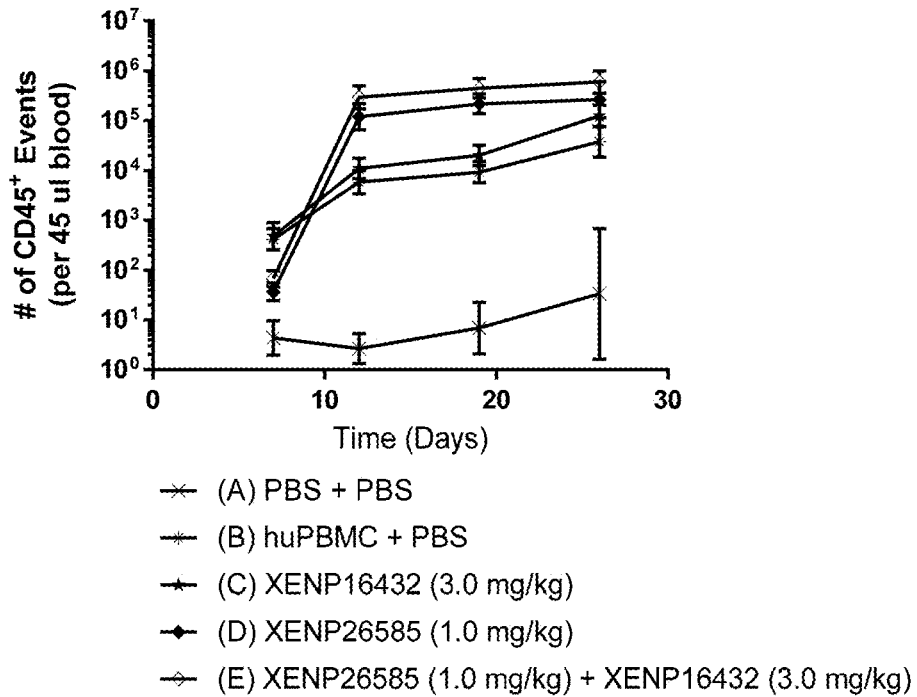
Figure 116B:
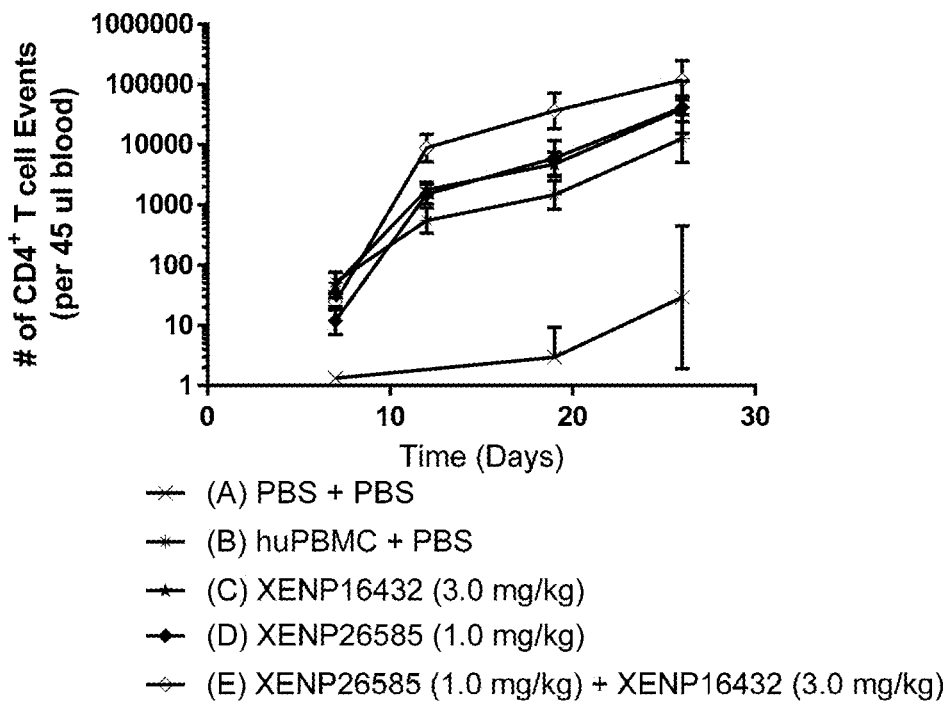
Figure 116C:
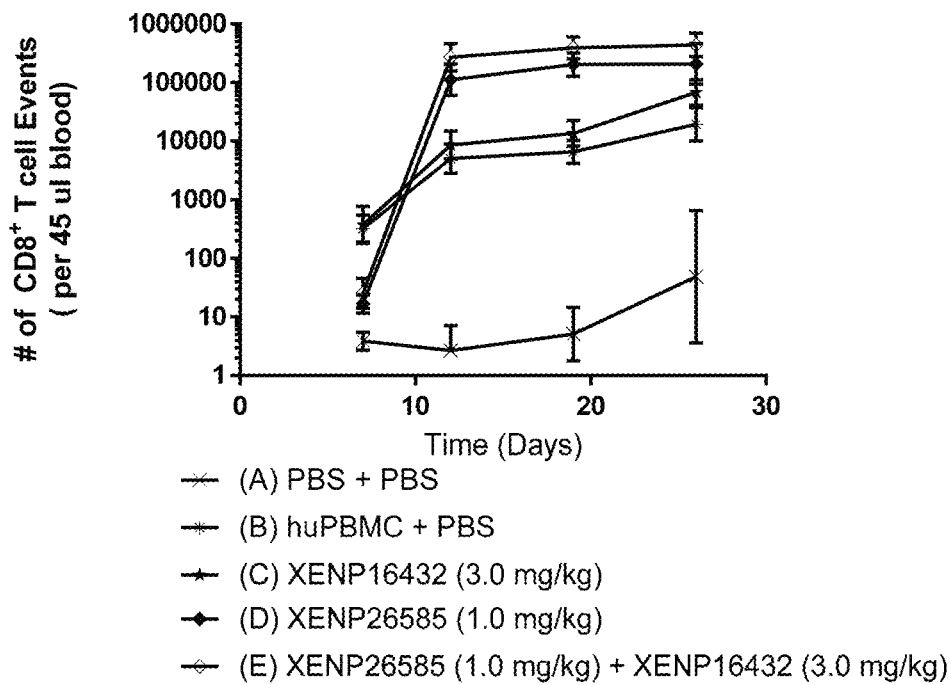
Figure 116D:
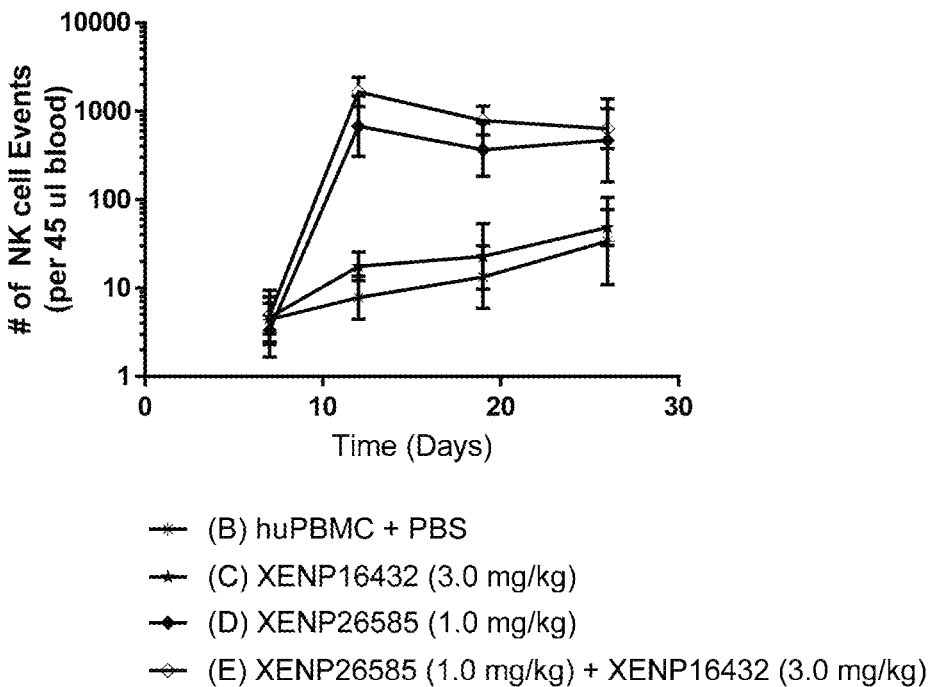
Figure 116E:
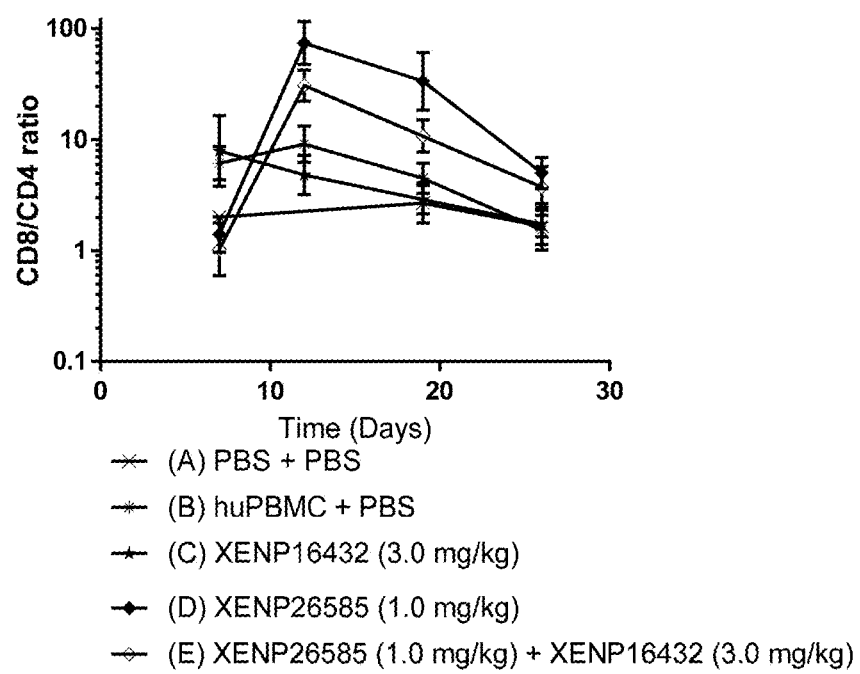

FIG. 115A-FIG. 115B depict (FIG. 115A) the mean tumor volume and (FIG. 115B) change in tumor volume in NSG mice engrafted with pp65-expressing MCF-7 cells, following engraftment with pp65 reactive huPBMC and treatment with indicated test articles.

FIG. 116A-FIG. 116E depict (FIG. 116A) CD45+ cell, (FIG. 116B) CD4+ T cell, (FIG. 116C) CD8+ T cell, and (FIG. 116D) NK cell counts as well as (FIG. 116E) CD8+/CD4+ T cell ratio in the whole blood of NSG mice engrafted with pp65-expressing MCF-7 cells following engraftment with pp65 reactive huPBMC and treatment with indicated test articles.

FIG. 117A-FIG. 117C depict the variable heavy and variable light chains for illustrative anti-NKG2D ABDs which find use in the NKG2D-targeted IL-15/Rα-Fc fusion proteins of the invention. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems.

FIG. 118 depicts sequences for a phage-derived anti-NKG2D antibody with an ablation variant (E233P/L234V/L235A/G236del/S267K, "IgG1_PVA_/S267k"). The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems.

FIG. 119 depicts the sequences for XENP25379, human NKG2D antigen, and XENP25380, cynomolgus NKG2D antigen used for phage panning, as well as XENP22490 (empty-Fc).

Figure 120:
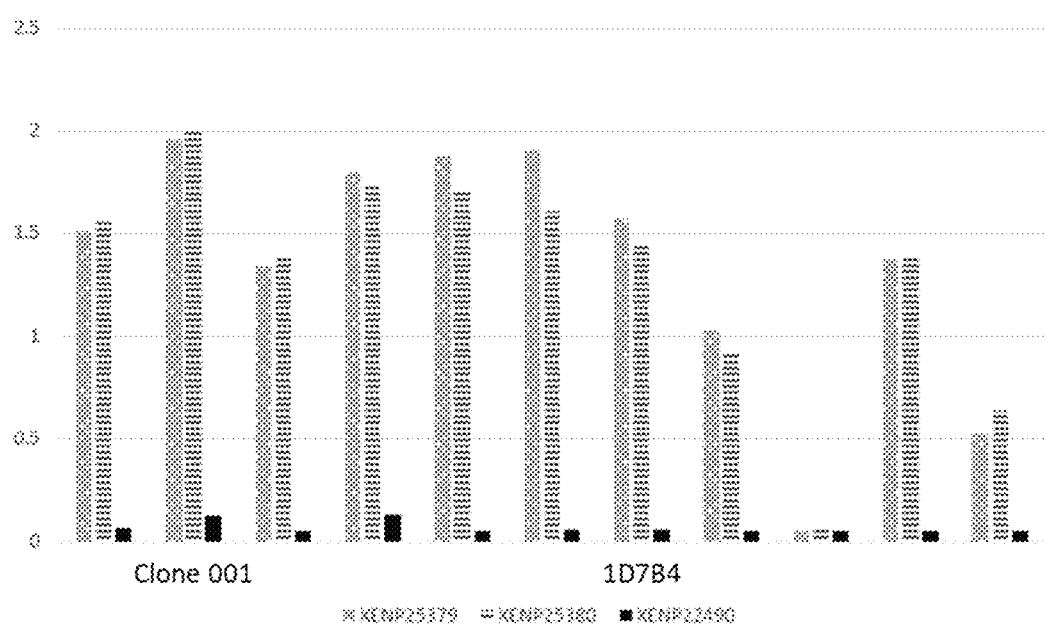

FIG. 120 depicts ELISA readout indicating relative binding of phage clones to XENP25379 (Fc-huNKG2D antigen), XENP25380 (Fc-cynoNKG2D antigen), and XENP22490 (empty-Fc). The data show that a number of the phage clones bound to both human and cynomolgus NKG2D.

Figure 121:
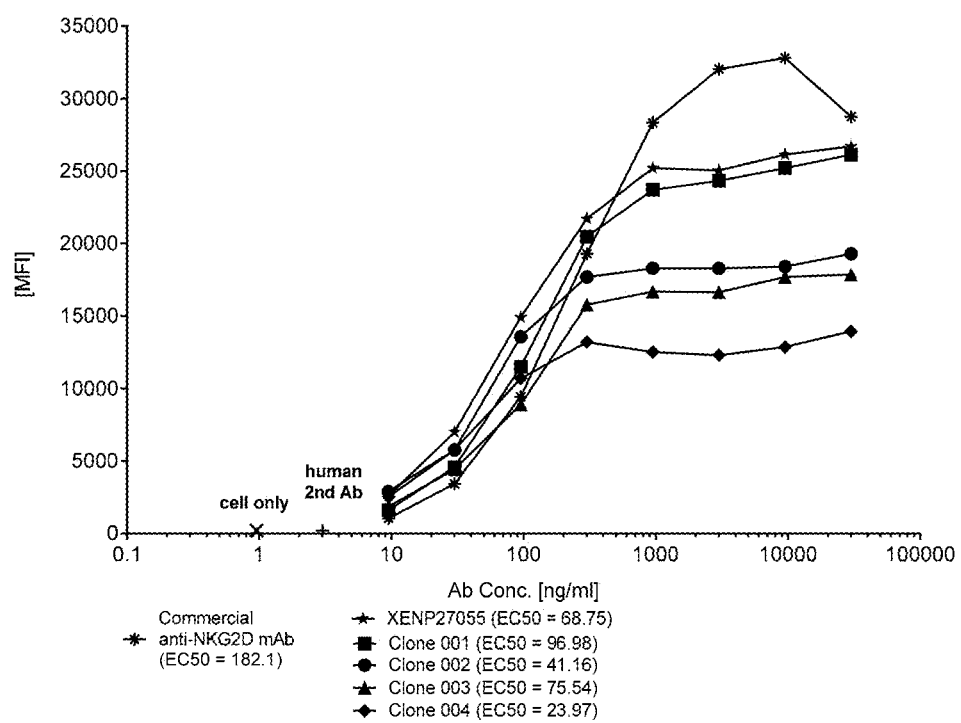

FIG. 121 depicts the binding of XENP27055 (bivalent anti-NKG2D mAb based on 1D7B4), four additional phage-derived anti-NKG2D mAbs as comparators, and a commercial anti-NKG2D antibody to NKG2D-transfected T-Rex™-293 cells. The data show a range of binding efficacy and potency.

FIG. 122A-FIG. 122N depict sequences of additional illustrative NKG2D-targeted IL-15/Rα-Fc fusion proteins of the "scIL-15/Rα x Fab" format comprising the IL-15(N4D/N65D) variant. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the VH and VL domains using other numbering systems. Linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions. It should be noted that while some of the sequences depicted herein comprise the M428L/N434S Xtend substitutions, each of the sequences depicted herein can either include or exclude the M428L/N434S Xtend substitutions.

FIG. 123 depicts dissociation constant ($K_D$), association rate ($k_a$), and dissociation rate ($k_d$) of NKG2D-targeted IL-15/Rα-Fc fusions for human NKG2D. * indicates poor fits from biphasic sensorgrams. The data show that the NKG2D-targeted IL-15/R-Fc fusions demonstrated a range of affinities for NKG2D.

Figure 124:
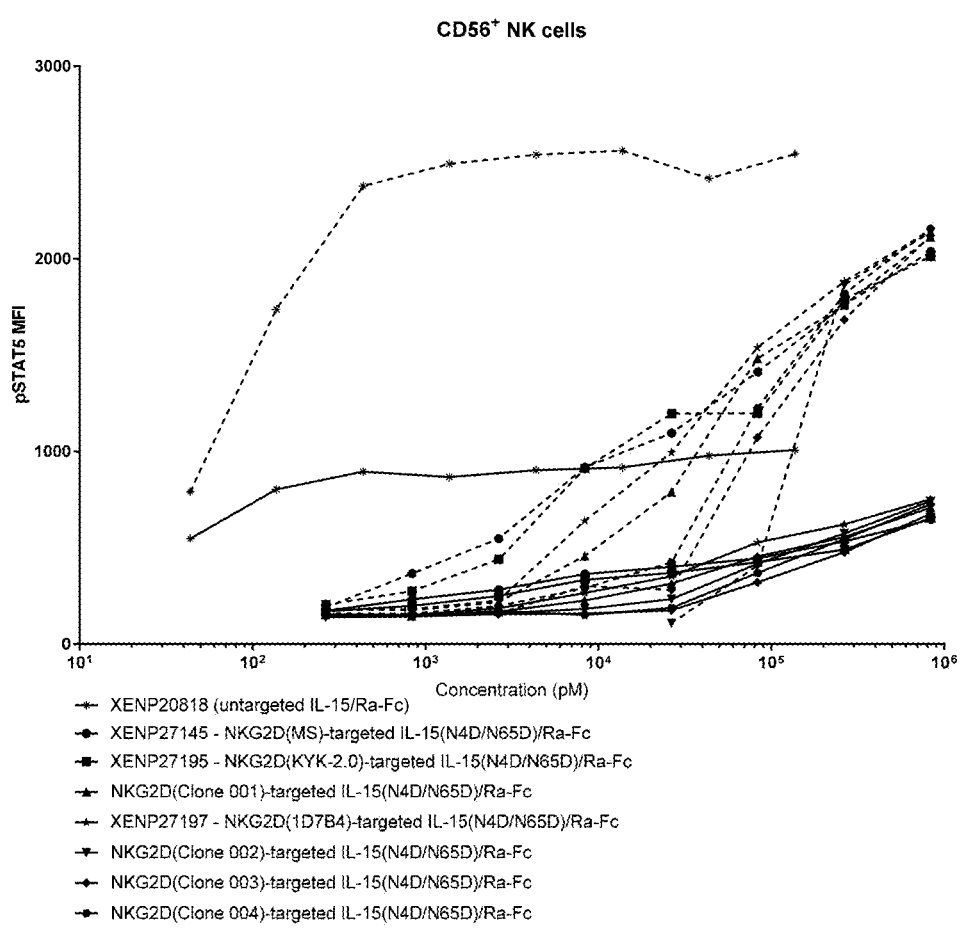

FIG. 124 depicts induction of STAT5 phosphorylation on CD56+ NK cells by XENP20818 (untargeted IL-15/Rα-Fc fusion) and illustrative NKG2D-targeted IL-15/Rα-Fc fusions based on phage-derived or prior art NKG2D ABDs. Fresh cells are indicated in solid lines, and activated cells are indicated in dotted lines. The data show a selectivity for NK cells from activated PBMCs by the NKG2D-targeted IL-15/Rα-Fc fusions.

FIG. 125A-FIG. 125C depict sequences for illustrative anti-NKG2D mAbs based on IgG1 format with E233P/L234V/L235A/G236_/S267K ablation variants). As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems.

FIG. 126A-FIG. 126F depict sequences for illustrative anti-NKG2D mAbs humanized using string content optimization (see, e.g., U.S. Pat. No. 7,657,380, issued Feb. 2, 2010) and based on IgG1 format with E233P/L234V/L235A/G236_/S267K ablation variants). As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems.

FIG. 127 depicts the dissociation constant ($K_D$), association rate ($k_a$), and dissociation rate ($k_d$) of illustrative bivalent anti-NKG2D mAbs for human NKG2D.

FIG. 128 depicts the sequences of XENP21993, an scIL-15/Rα-Fc fusion comprising a wild-type IL-15. IL-15 and IL-15Rα(sushi) are underlined, linkers are double underlined (although as will be appreciated by those in the art, the linkers can be replaced by other linkers, some of which are depicted in the Figures, and slashes (/) indicate the border(s) between IL-15, IL-15Rα, linkers, and constant/Fc regions.

FIG. 129 depicts the sequences of XENP22853, an IL-15/Rα-heteroFc fusion comprising a wild-type IL-15 and Xtend Fc (M428L/N434S) variant. IL-15 and IL-15Rα(sushi) are underlined, linkers are double underlined (although as will be appreciated by those in the art, the linkers can be replaced by other linkers, some of which are depicted in the Figures, and slashes (/) indicate the border(s) between IL-15, IL-15Rα, linkers, and constant/Fc regions.

FIG. 130 depicts the sequences of XENP24050, an scIL-15/Rα-Fc fusion comprising an IL-15(N4D/N65D) variant. IL-15 and IL-15Rα(sushi) are underlined, linkers are double underlined (although as will be appreciated by those in the art, the linkers can be replaced by other linkers, some of which are depicted in the Figures, and slashes (/) indicate the border(s) between IL-15, IL-15Rα, linkers, and constant/Fc regions.

FIG. 131 depicts the sequences of XENP4113, an scIL-15/Rα-Fc fusion comprising an IL-15(N4D/N65D) variant and Xtend Fc (M428L/N434S) variant. IL-15 and IL-15Rα (sushi) are underlined, linkers are double underlined (although as will be appreciated by those in the art, the linkers can be replaced by other linkers, some of which are depicted in the Figures, and slashes (/) indicate the border(s) between IL-15, IL-15Rα, linkers, and constant/Fc regions.

FIG. 132 depicts the sequences of XENP24294, an scIL-15/Rα-Fc fusion comprising an IL-15(N4D/N65D) variant and Xtend Fc (M428L/N434S) substitution. IL-15 and IL-15Rα(sushi) are underlined, linkers are double underlined (although as will be appreciated by those in the art, the linkers can be replaced by other linkers, some of which are depicted in the Figures, and slashes (/) indicate the border(s) between IL-15, IL-15Rα, linkers, and constant/Fc regions.

FIG. 133 depicts the sequences of XENP24306, an IL-15/Rα-heteroFc fusion comprising an IL-15(D30N/E64Q/N65D) variant and Xtend Fc (M428L/N434S) substitution. IL-15 and IL-15Rα(sushi) are underlined, linkers are double underlined (although as will be appreciated by those in the art, the linkers can be replaced by other linkers, some of which are depicted in the Figures, and slashes (/) indicate the border(s) between IL-15, IL-15Rα, linkers, and constant/Fc regions.

Figure 134:
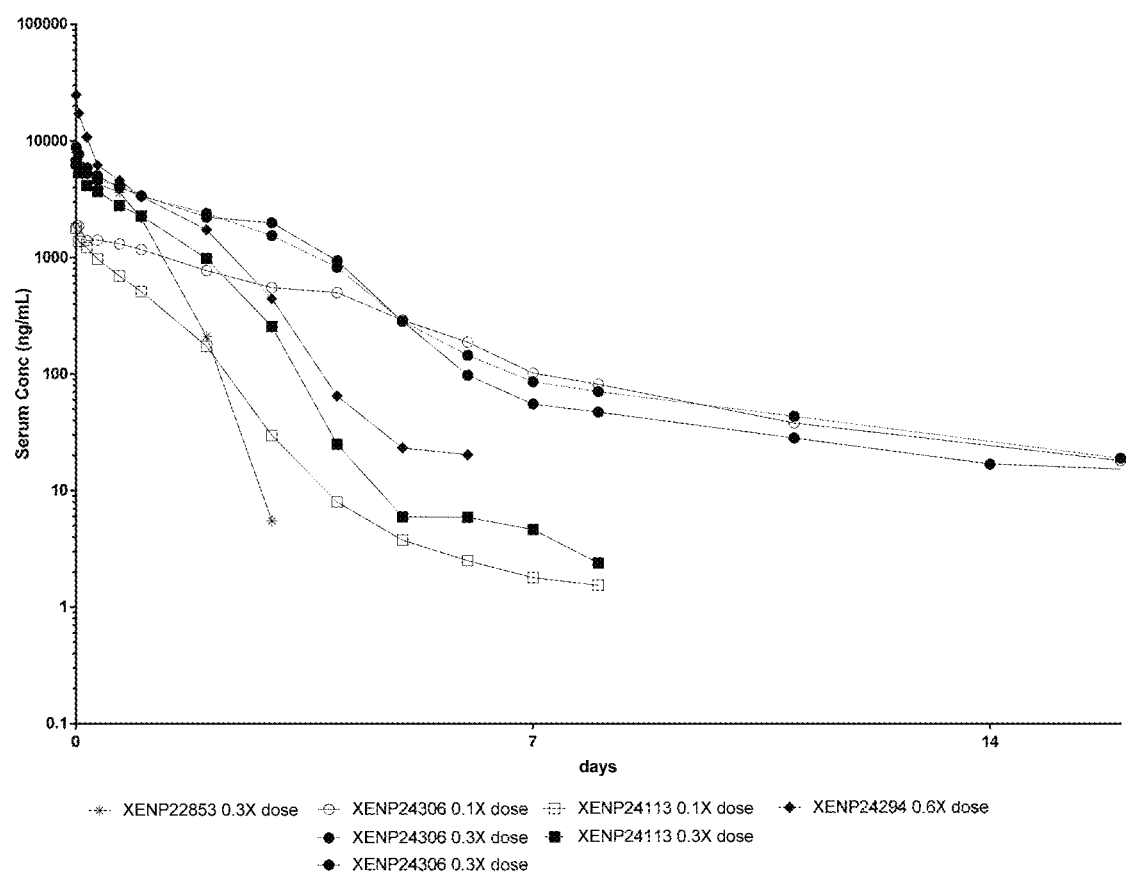
Figure 137A:
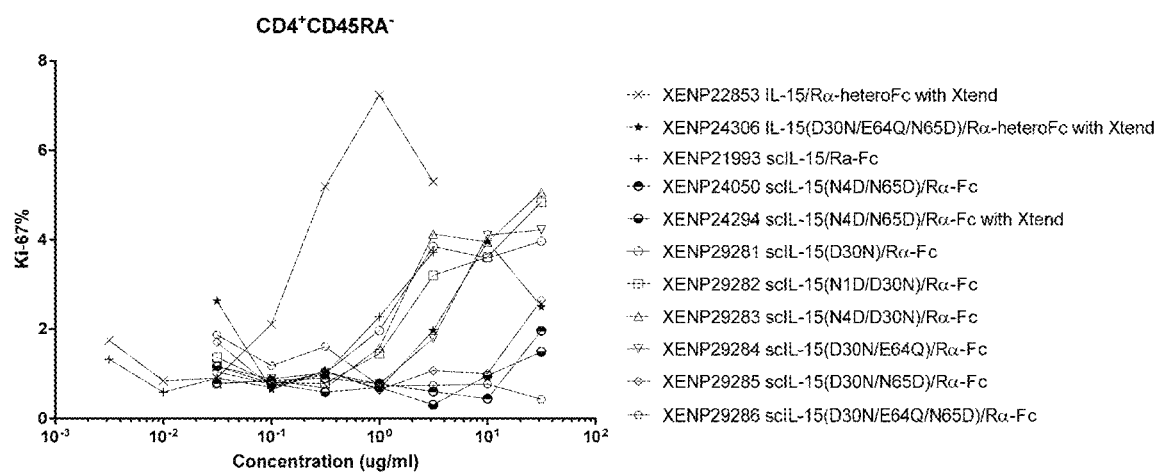
Figure 137B:
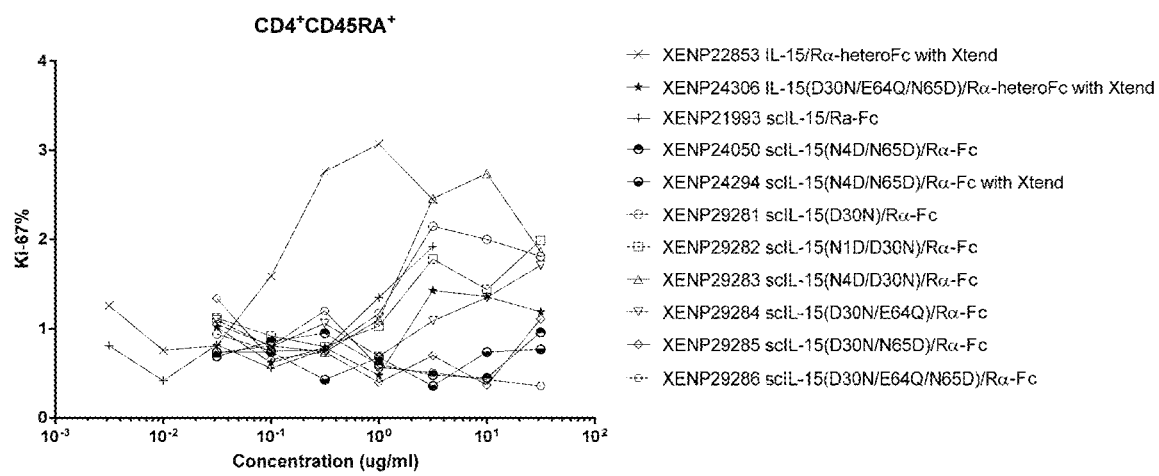
Figure 137C:
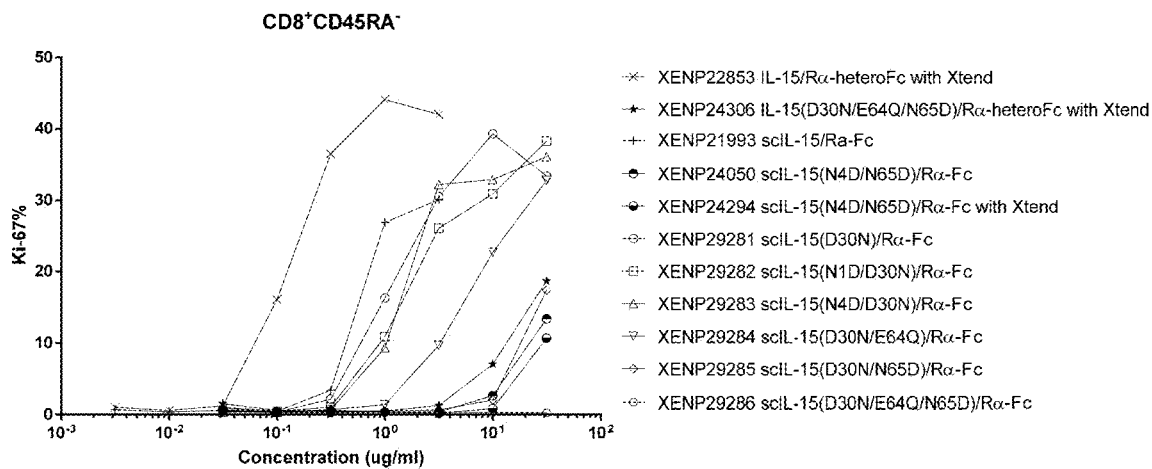
Figure 137D:
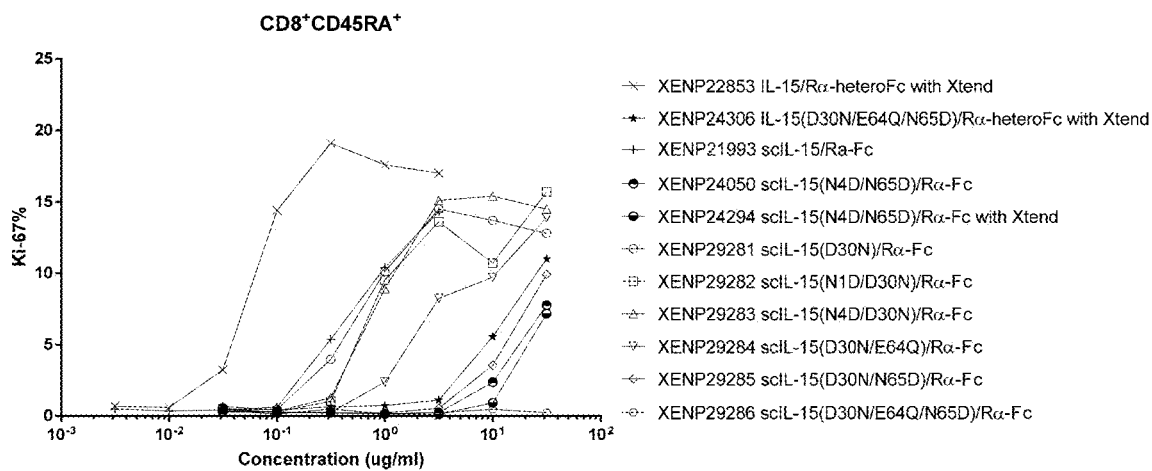
Figure 137E:
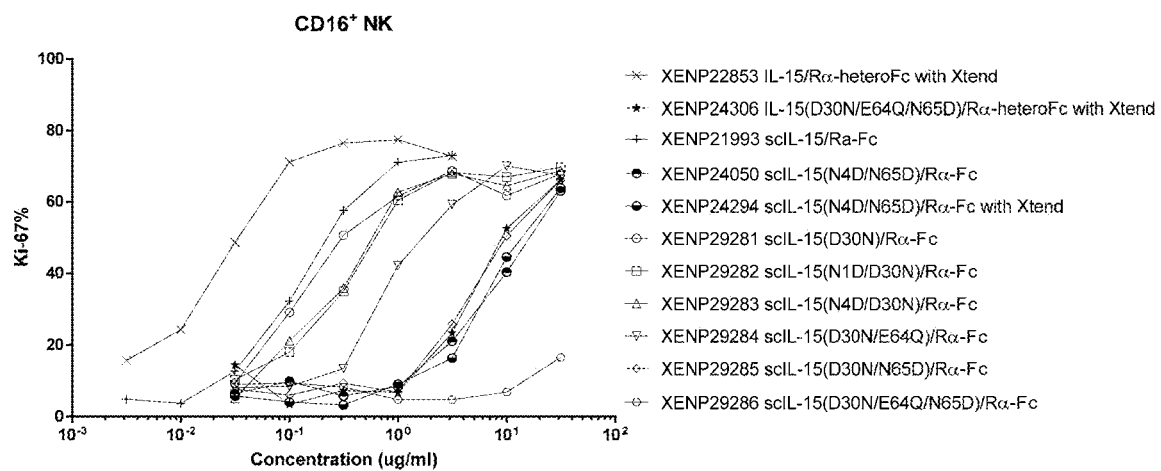
Figure 137F:
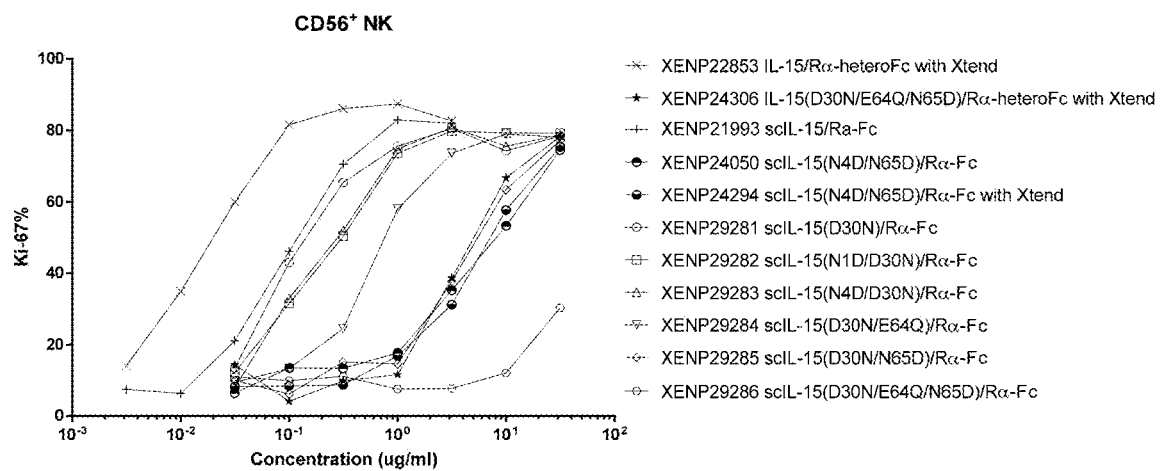
Figure 137G:
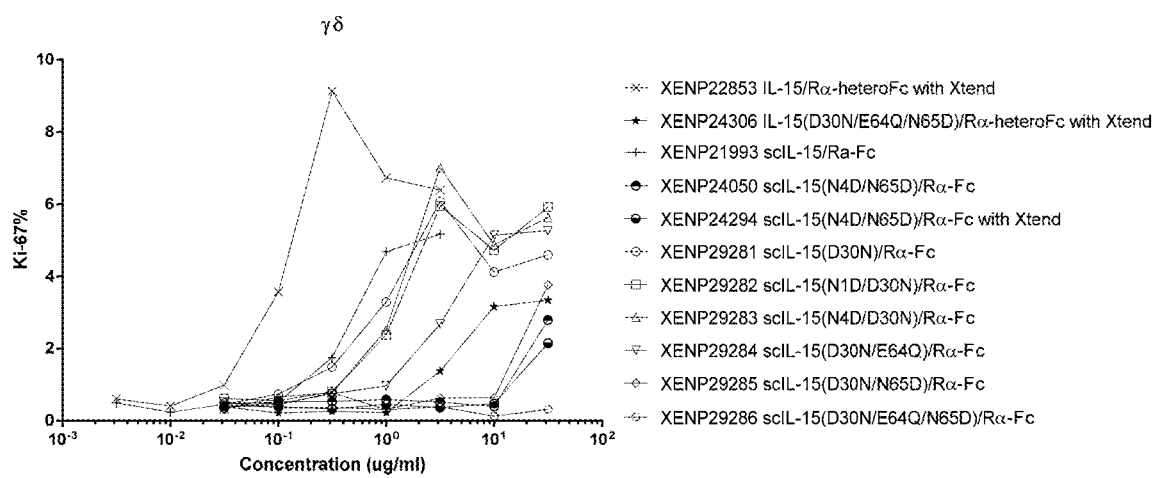

FIG. 134 depicts the serum concentration of the indicated test articles over time in cynomolgus monkeys following a first dose at the indicated relative concentrations.

FIG. 135 depicts sequences for illustrative IL-15 variants engineered for reduced potency and comprising a D30N substitution. Including within each of these variant IL-15 sequences are sequences that are 90%, 95%, 98% and 99% identical (as defined herein) to the recited sequences, and/or contain from 1, 2, 3, 4, 5, 6, 7, 8, 9 or 10 additional amino acid substitutions. In a nonlimiting example, the recited sequences may contain additional amino acid modifications such as those contributing to formation of covalent disulfide bonds as described in Example 2.

FIG. 136A-FIG. 136B depict illustrative scIL-15/Rα-Fc fusions having IL-15 variants comprising D30N substitution. IL-15 and IL-15Rα(sushi) are underlined, linkers are double underlined (although as will be appreciated by those in the art, the linkers can be replaced by other linkers, some of which are depicted in the Figures, and slashes (/) indicate the border(s) between IL-15, IL-15Rα, linkers, and constant/Fc regions.

FIG. 137A-FIG. 137G depict percentage of A) CD4+CD45RA−, B) CD4+CD45RA+, C) CD8+CD45RA−, D) CD8+CD45RA+, E) CD16+ NK cells, F) CD56+ NK cells, and G) γδ cells expression Ki67 following incubation with the indicated test articles.

FIG. 138A-FIG. 138C depict sequences of additional illustrative NKG2D-targeted IL-15/Rα-Fc fusion proteins of the "scIL-15/Rα x Fab" format comprising the IL-15(D30N/N65D) variant. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Linkers are double underlined (although as will be appreciated by those in the art, the linkers can be replaced by other linkers, some of which are depicted in FIG. 6 and FIG. 7), and slashes (/) indicate the border(s) between IL-15, IL-15Rα, linkers, variable regions, and constant/Fc regions. It should be noted that while some of the sequences depicted herein comprise the M428L/N434S Xtend substitutions, each of the sequences depicted herein can either include or exclude the M428L/N434S Xtend substitutions.

FIG. 139A-FIG. 139J depict sequences of additional illustrative NKG2D-targeted IL-15/Rα-Fc fusion proteins of the "scIL-15/Rα x Fab" format comprising the IL-15(D30N/E64Q/N65D) variant. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. Linkers are double underlined (although as will be appreciated by those in the art, the linkers can be replaced by other linkers, some of which are depicted in FIGS. 6 and 7), and slashes (/) indicate the border(s) between IL-15, IL-15Rα, linkers, variable regions, and constant/Fc regions. It should be noted that while some of the sequences depicted herein comprise the M428L/N434S Xtend substitutions, each of the sequences depicted herein can either include or exclude the M428L/N434S Xtend substitutions.

FIG. 140A-FIG. 140C depict the sequences of control RSV-targeted IL-15/Rα-Fc fusion. The CDRs are underlined. As noted herein and is true for every sequence herein containing CDRs, the exact identification of the CDR locations may be slightly different depending on the numbering used as is shown in Table 2, and thus included herein are not only the CDRs that are underlined but also CDRs included within the $V_H$ and $V_L$ domains using other numbering systems. IL-15 and IL-15Rα(sushi) are italicized, linkers are double underlined (although as will be appreciated by those in the art, the linkers can be replaced by other linkers, some of which are depicted in FIG. 6 and FIG. 7), and slashes (/) indicate the border(s) between IL-15, IL-15Rα, linkers, variable regions, and constant/Fc regions. As will be clear to those skilled in the art, each of the NKG2D-targeted IL-15/Rα-Fc fusion proteins described can also include or exclude Xtend Fc (M428L/N434S).

Figure 141:
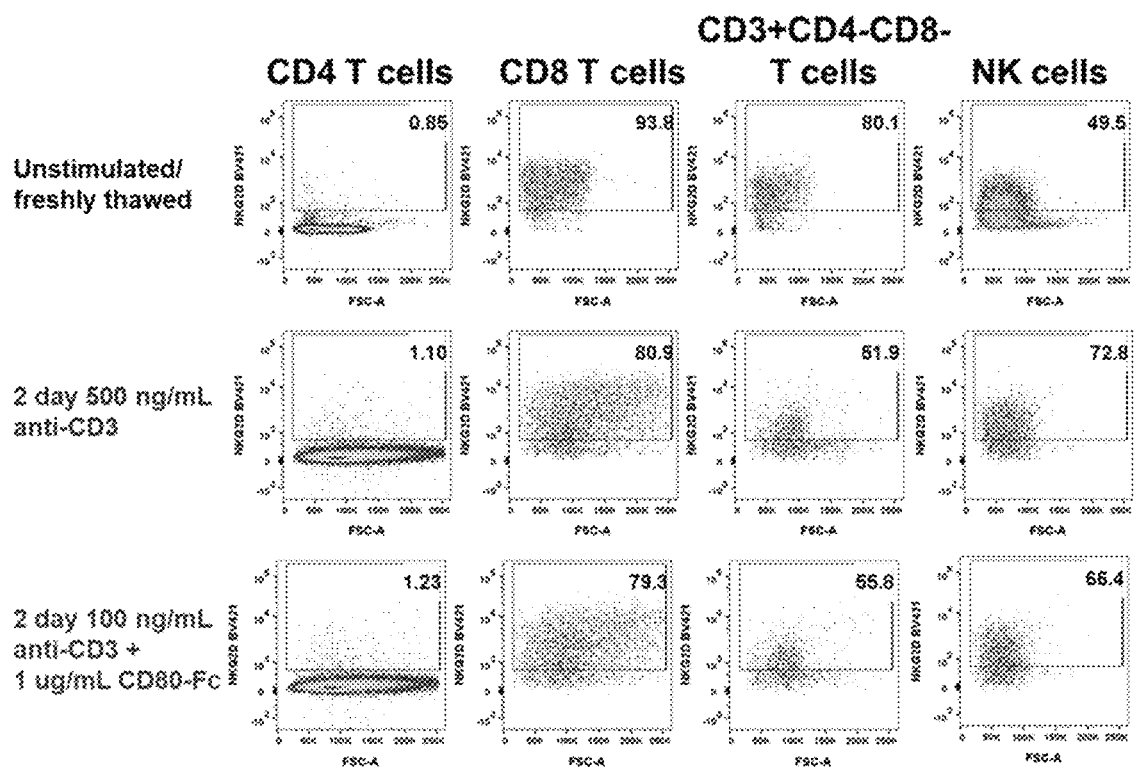

FIG. 141 shows NKG2D expression in CD4 T cells, CD8 T cells, CD3+ CD4− CD8− T cells, and NK cells before and after stimulation with either 500 ng/ml plate-bound anti-CD3 (OKT3) or 100 ng/ml plate-bound anti-CD3 (OKT)+1 μg/ml plate-bound CD80-Fc. The data show that NKG2D is selectively expressed on CD8 T cells, CD3+ CD4-CD8− T cells, and NK cells in comparison to CD4 T cells.

Figure 142:
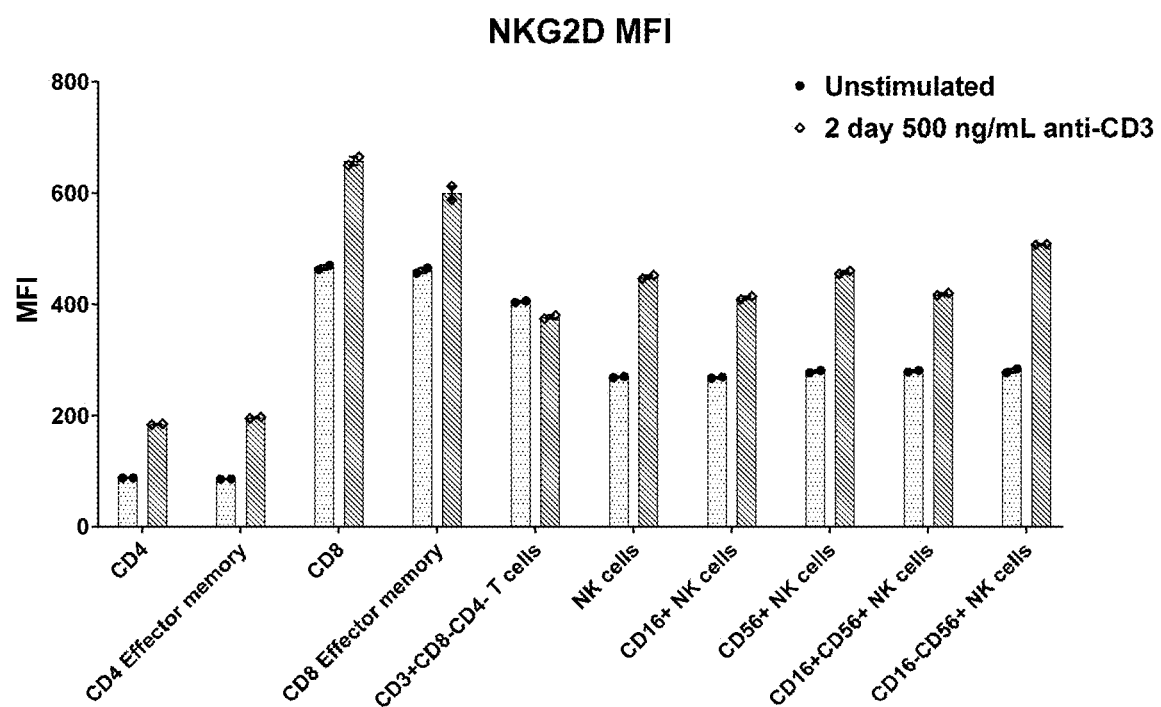

FIG. 142 shows NKG2D expression in CD4 T cells, CD8 T cells, CD3+ CD4− CD8− T cells, and NK cells before and after stimulation with either 500 ng/ml plate-bound anti-CD3 (OKT3). The data show that NKG2D is selectively expressed on CD8 T cells, CD3+ CD4-CD8− T cells, and NK cells in comparison to CD4 T cells.

Figure 143:
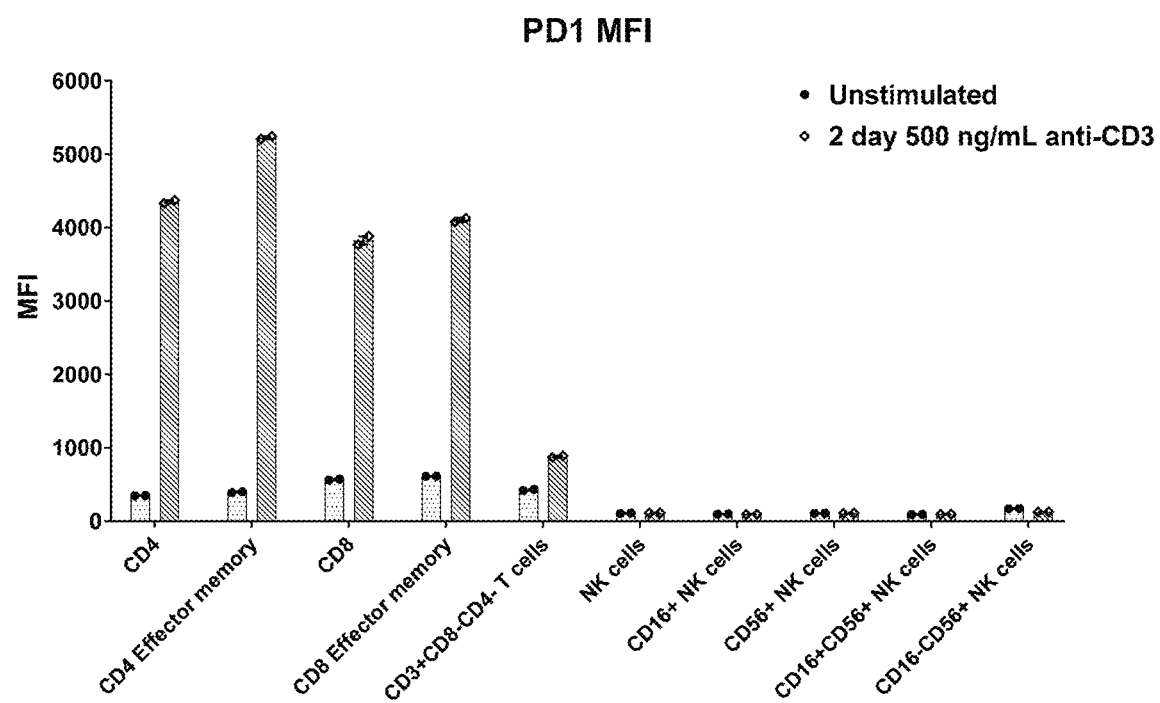

FIG. 143 shows PD-1 expression in CD4 T cells, CD8 T cells, CD3+ CD4− CD8− T cells, and NK cells before and after stimulation with either 500 ng/ml plate-bound anti-CD3 (OKT3). The data show that PD-1 is upregulated on both CD8 T cells and CD4 T cells upon stimulation.

Figure 144A:
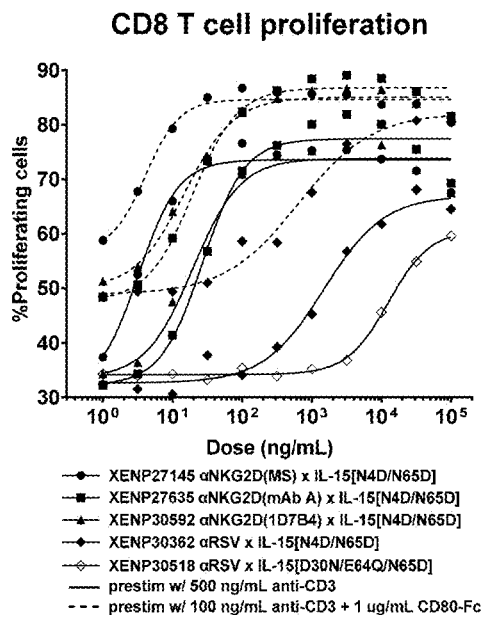
Figure 144B:
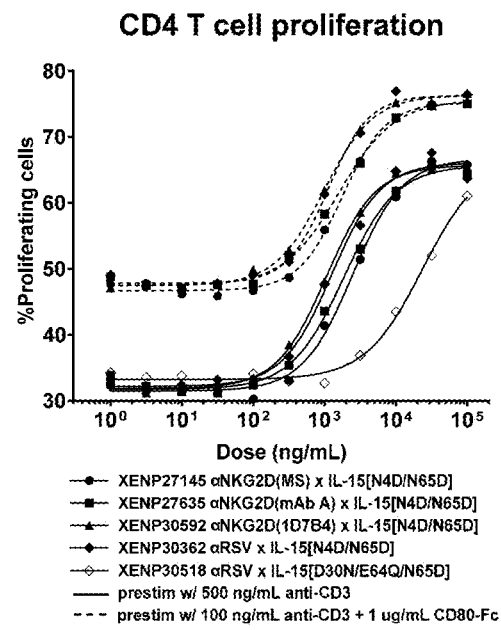
Figure 144C:
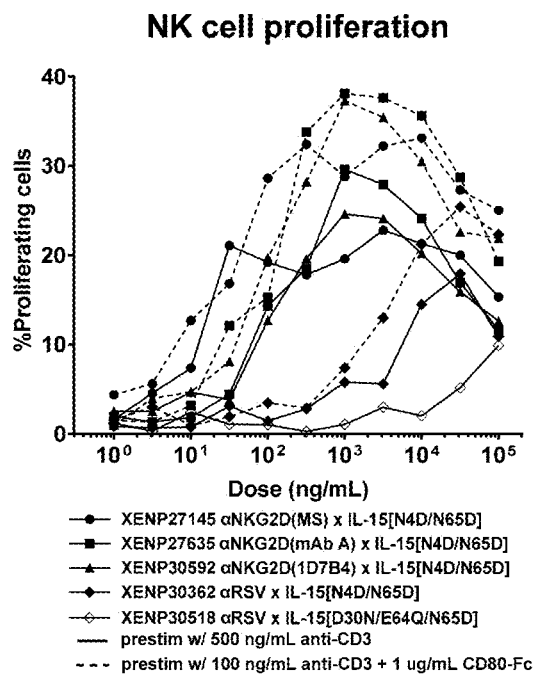

FIG. 144A-FIG. 144C depict induction of A) CD8+ T cell, B) CD4+ T cell, and C) NK cell proliferation by NKG2D-targeted IL-15/Rα-Fc fusions (XENP27145, XENP27635, and XENP30592) and control RSV-targeted IL-15/Rα-Fc fusions (XENP30362 and XENP30518) as indicated by percentage proliferating cells (determined based on CFSE dilution). The data show that each of the NKG2D-targeted IL-15/Rα-Fc fusions were more potent in inducing proliferation of CD8+ T cells and NK cells in comparison to control RSV-targeted IL-15/Rα-Fc fusions. Notably, each of the NKG2D-targeted IL-15/Rα-Fc fusions demonstrated equivalent potency in inducing proliferation of CD4+ T cells as RSV-targeted IL-15/Rα-Fc fusions having the same IL-15 variant.

Figure 145A:
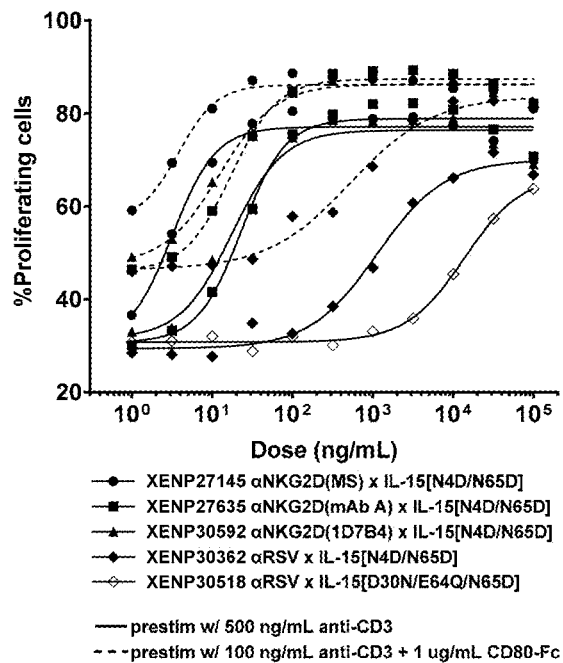
Figure 145B:
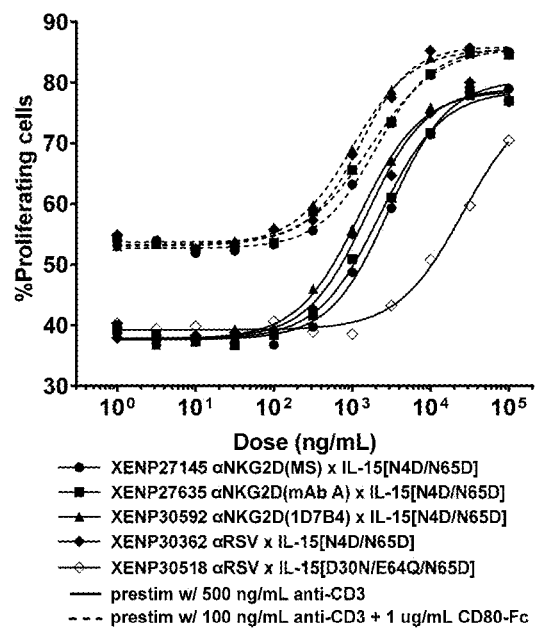

FIG. 145A-FIG. 145B depict induction of A) CD8 effector memory T cell (CD8+CD45RA-CD45RO+CCR7-CD28+/−CD95+) and B) CD4 effector memory T cell (CD8+CD45RA-CD45RO+CCR7-CD28+/−CD95+) proliferation by NKG2D-targeted IL-15/Rα-Fc fusions (XENP27145, XENP27635, and XENP30592) and control RSV-targeted IL-15/Rα-Fc fusions (XENP30362 and XENP30518) as indicated by percentage proliferating cells (determined based on CFSE dilution). The data show that each of the NKG2D-targeted IL-15/Rα-Fc fusions were more potent in inducing proliferation of CD8 effector memory T cells in comparison to control RSV-targeted IL-15/Rα-Fc fusions. Notably, each of the NKG2D-targeted IL-15/Rα-Fc fusions demonstrated equivalent potency in inducing proliferation of CD4 effector memory T cells as RSV-targeted IL-15/Rα-Fc fusions having the same IL-15 variant.

Figure 146:
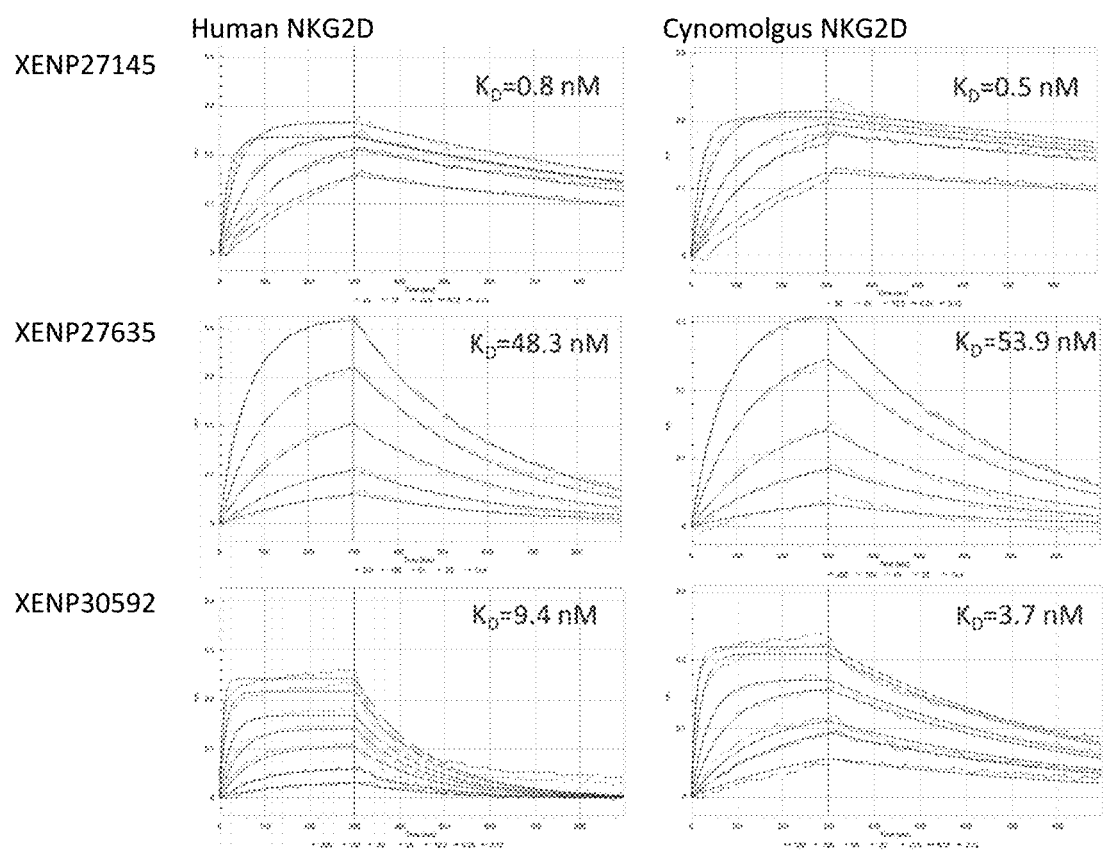

FIG. 146 depicts dissociation constant ($K_D$) of NKG2D-targeted IL-15/Rα-Fc fusions for human and cynomolgus NKG2D, as well as corresponding sensorgrams.

Figure 147A:
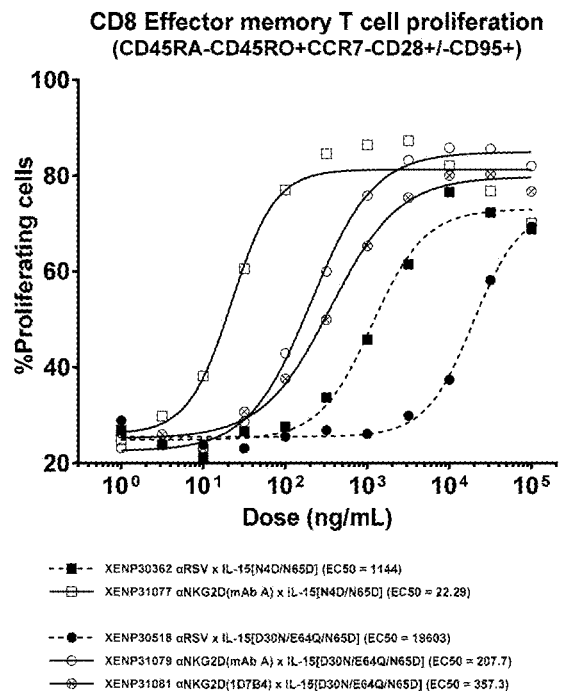
Figure 147B:
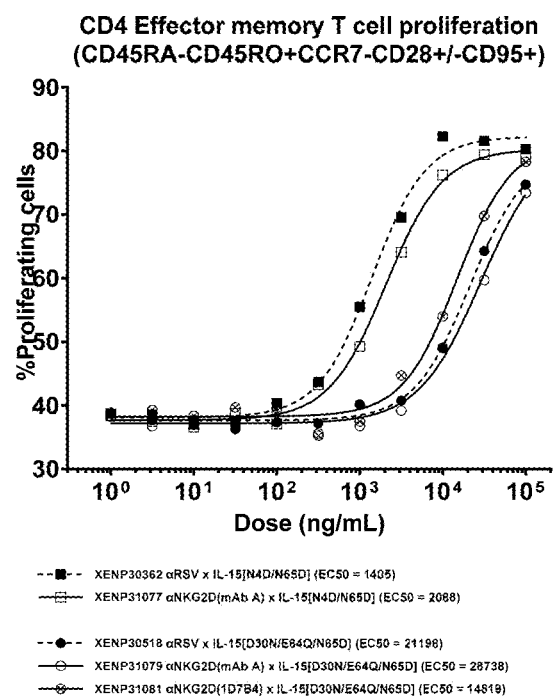
Figure 147C:
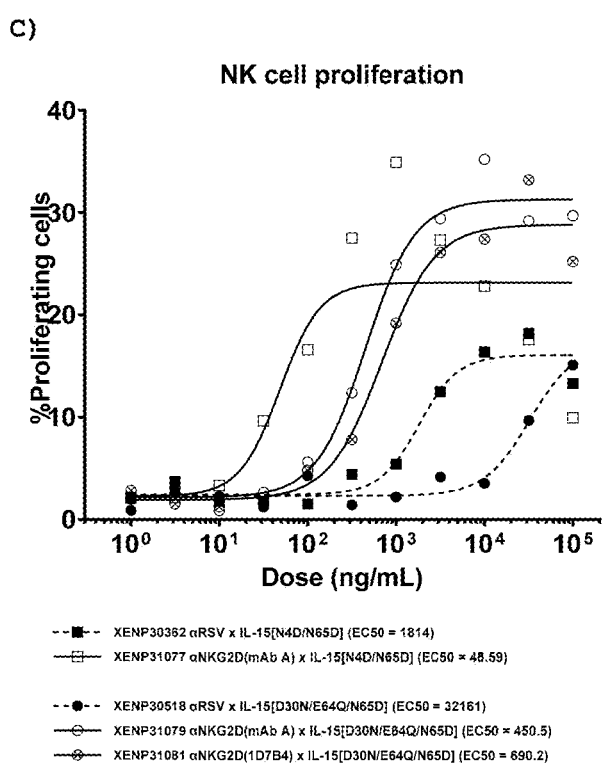
Figure 148A:
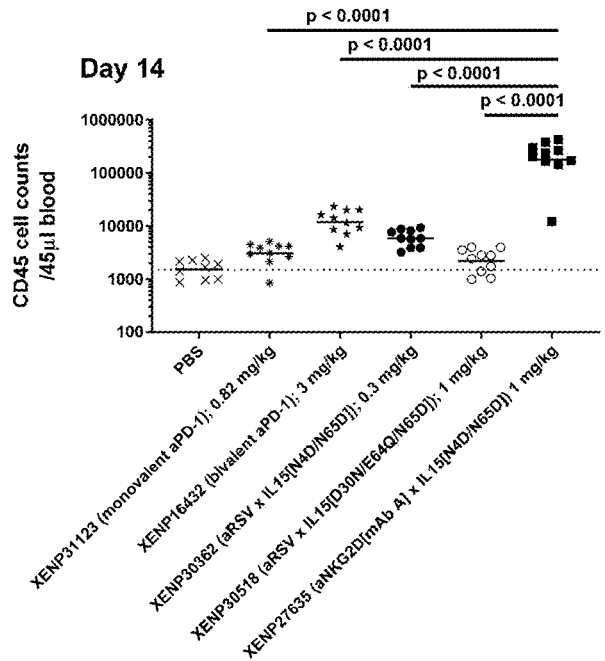
Figure 148B:
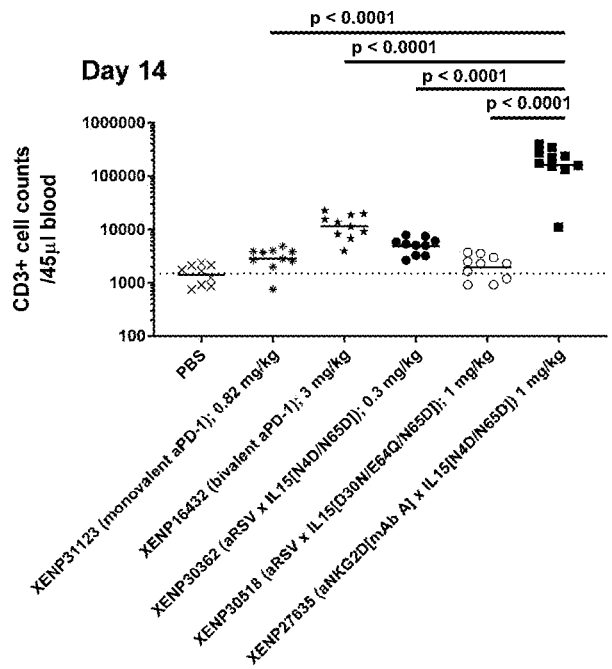
Figure 148C:
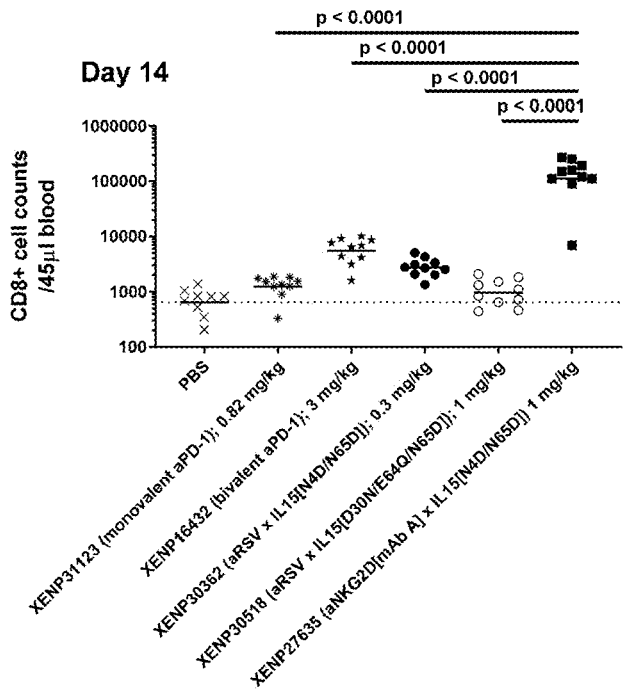
Figure 147D:
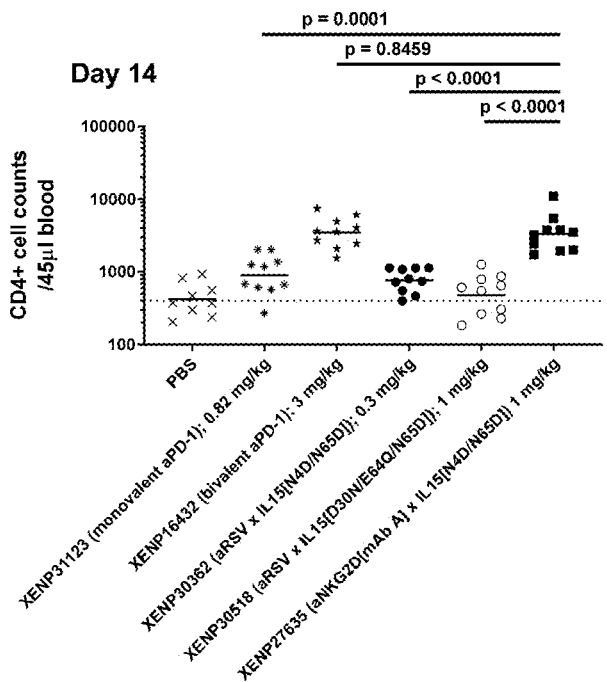
Figure 148E:
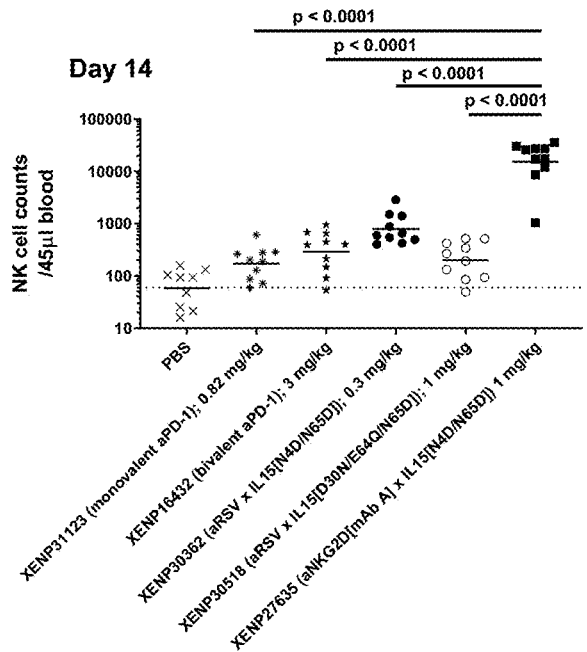
Figure 147F:
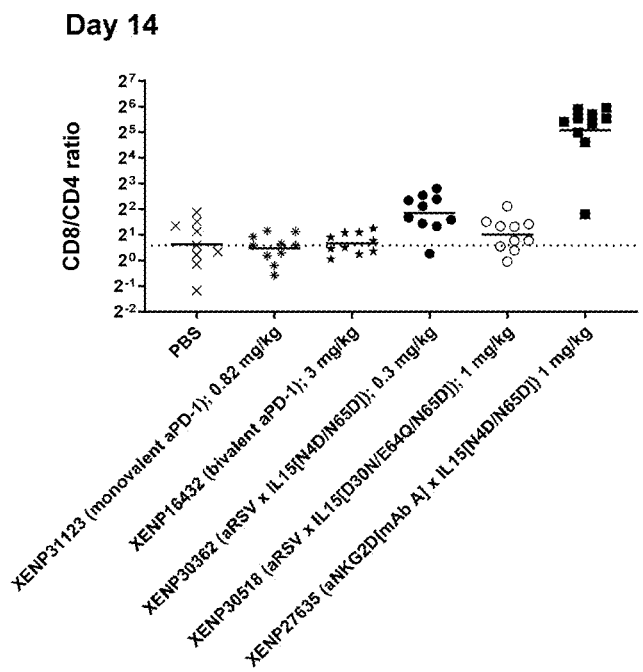
Figure 149A:
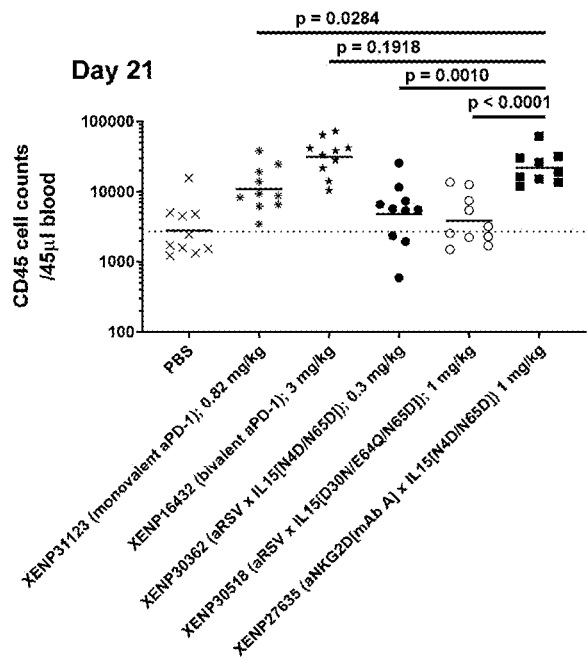
Figure 149B:
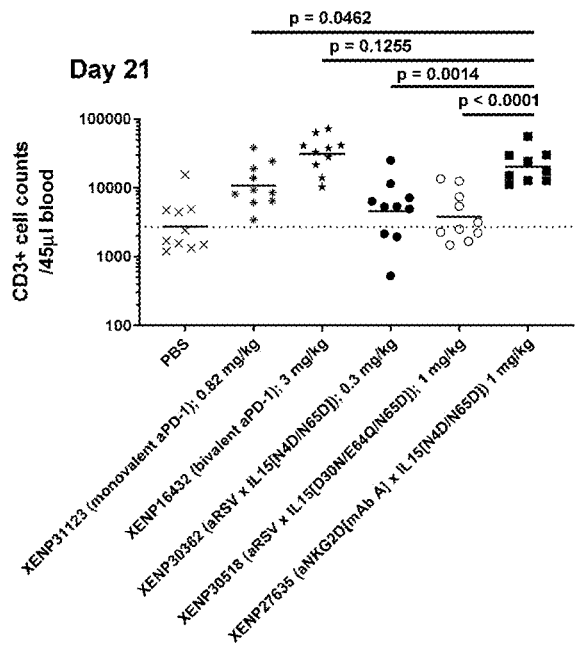
Figure 149C:
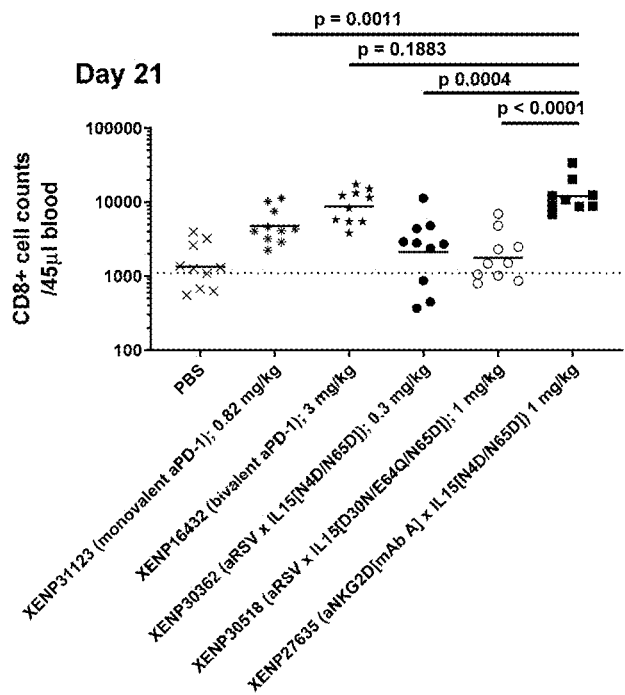
Figure 149D:
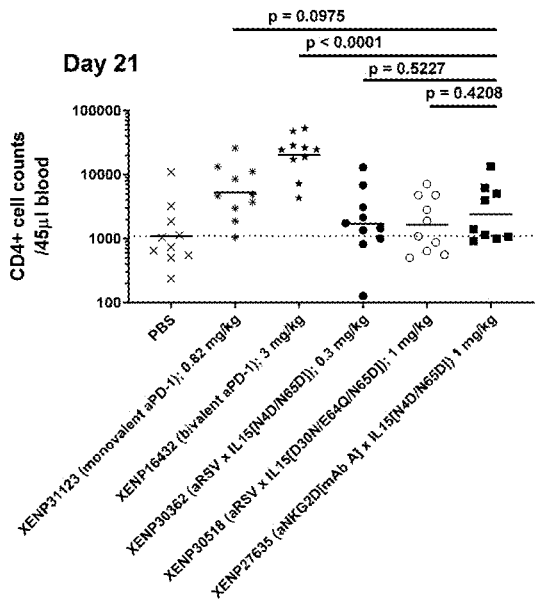
Figure 149E:
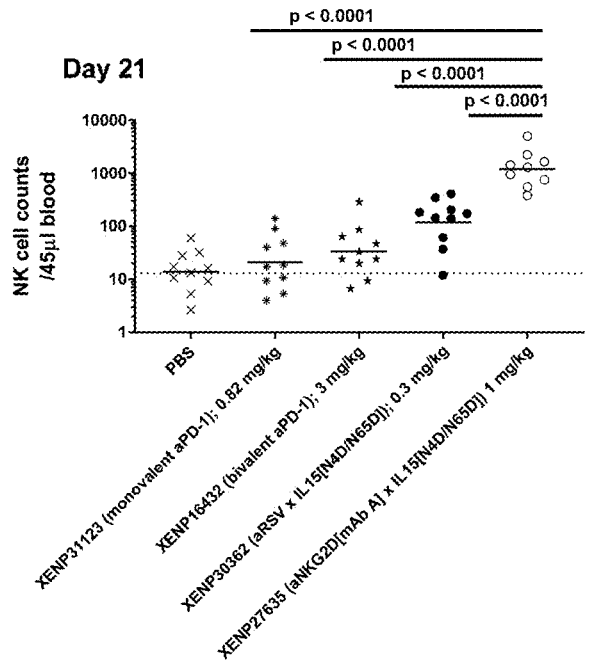
Figure 149F:
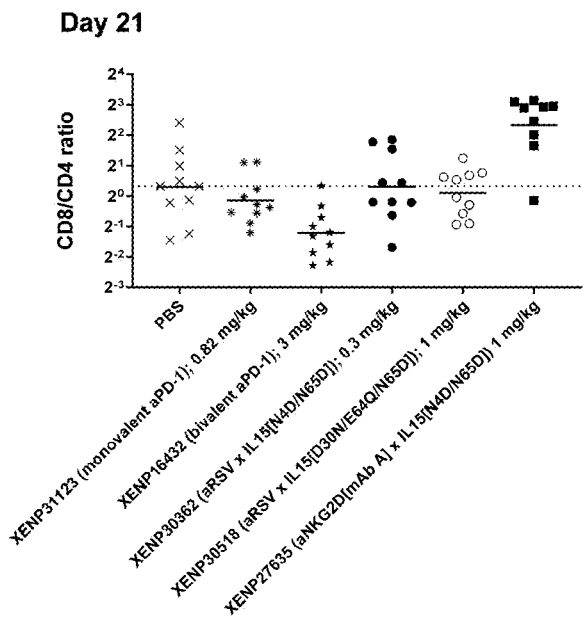
Figure 150A:
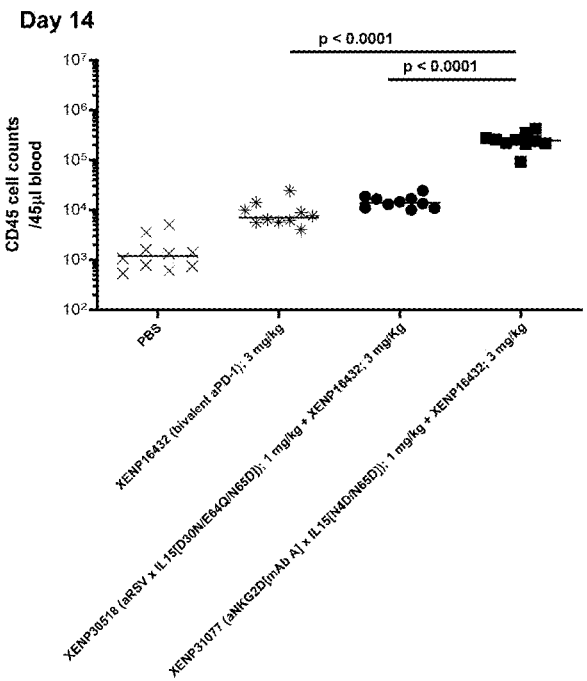
Figure 150B:
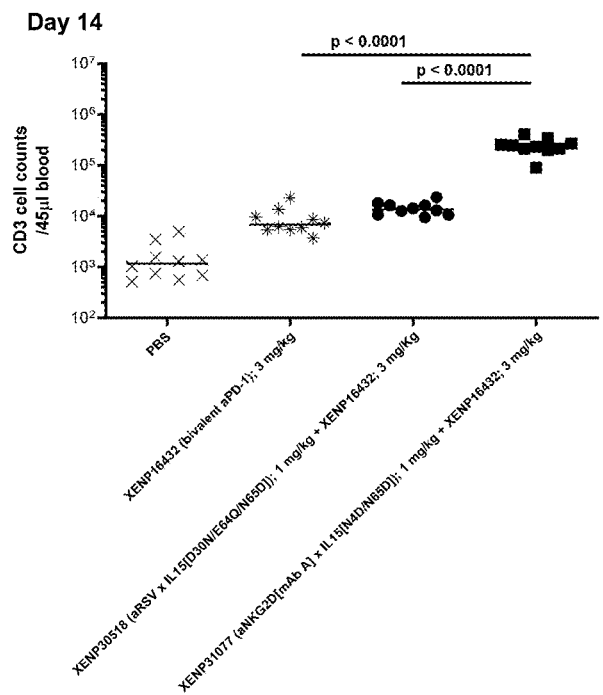
Figure 150C:
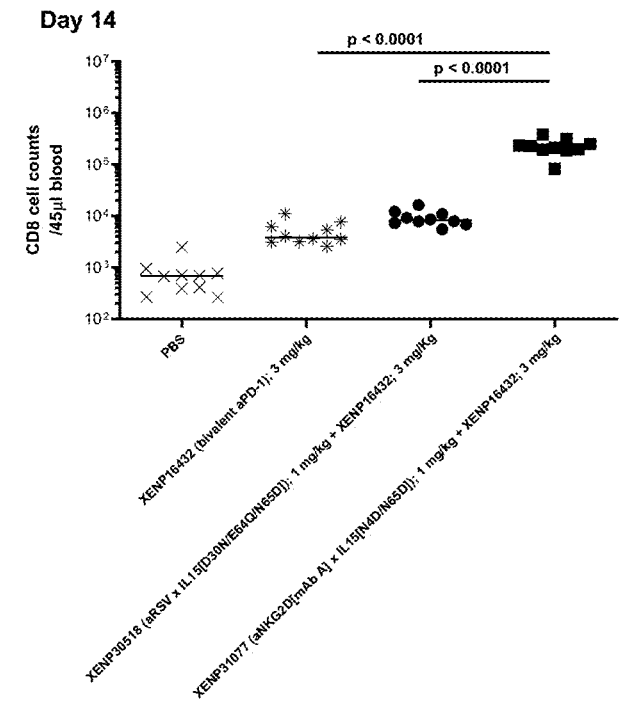
Figure 150D:
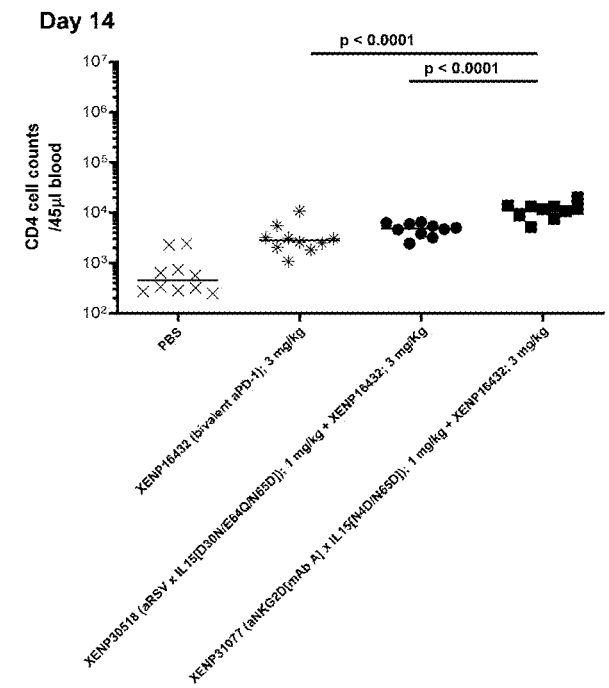
Figure 150E:
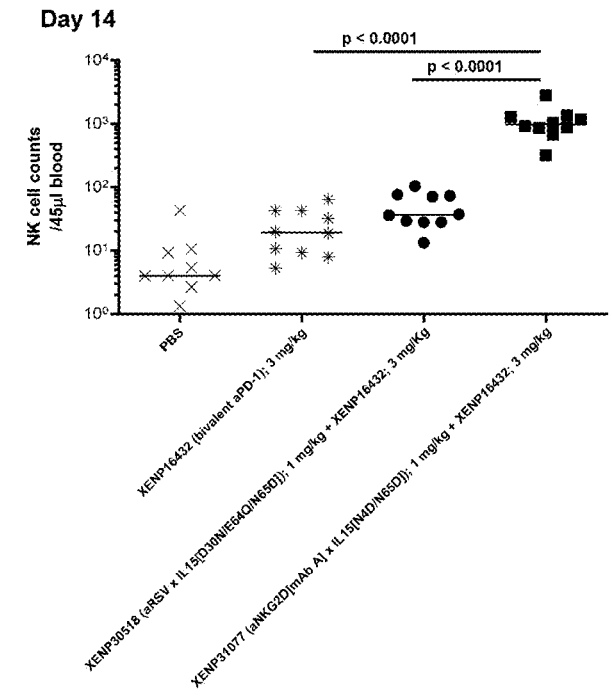
Figure 150F:
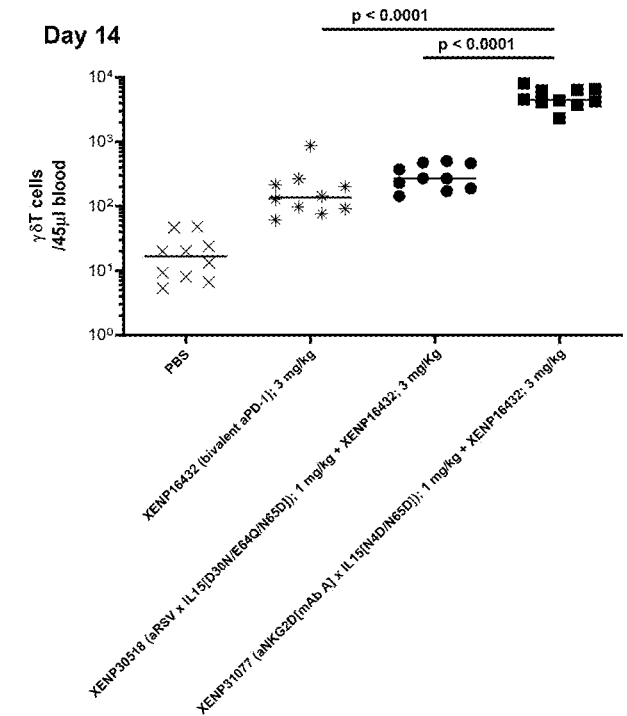
Figure 150G:
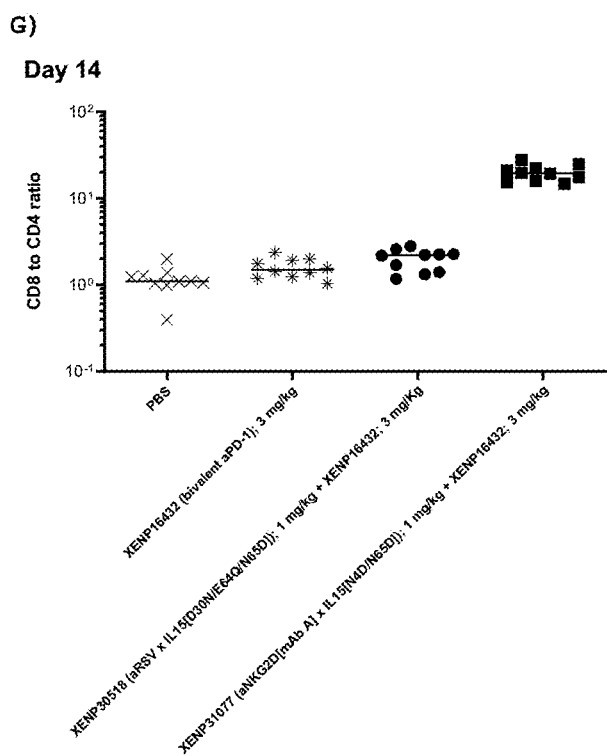

FIG. 147A-FIG. 147C depict induction of A) CD8 effector memory T cell (CD8+CD45RA-CD45RO+CCR7-CD28+/-CD95+), B) CD4 effector memory T cell (CD8+CD45RA-CD45RO+CCR7-CD28+/-CD95+), and C) NK cell proliferation by NKG2D-targeted IL-15/Rα-Fc fusions (XENP31077, XENP31079, and XENP31081) and control RSV-targeted IL-15/Rα-Fc fusions (XENP30362 and XENP30518) as indicated by percentage proliferating cells (determined based on CFSE dilution). The data show that NKG2D-targeted IL-15/Rα-Fc fusions with the less potent IL-15 [D30N/E64Q/N65D] variant were less potent in inducing proliferation of CD8+ T cells, CD4+ T cells, and NK cells than corresponding NKG2D-targeted IL-15/Rα-Fc fusions with the more potent IL-15[N4D/N65D] variant. The NKG2D-targeted IL-15/Rα-Fc fusions with IL-15 [D30N/E64Q/N65D] variant were more potent than both lower and higher potency RSV-targeted controls in inducing proliferation of CD8+ T and NK cells; however, the NKG2D-targeted IL-15/Rα-Fc fusions with IL-15[D30N/E64Q/N65D] variant were less potent than the higher potency RSV-targeted control (and as low in potency as the lower potency RSV-targeted control).

FIG. 148A-FIG. 148F depict number of human A) CD45+ cells, B) CD3+ T cells, C) CD8+ T cells, D) CD4+ T cells, and E) NK cells, as well as F) CD8 to CD4 T cell ratio in blood of pp65-MCF7 and huPBMC-engrafted NSG-DKO mice on Day 14 after first dose with indicated test articles. Statistics for cell expansion performed on log-transformed data using unpaired t-test. $p<0.05$ indicates significant difference in expansion.

FIG. 149A-FIG. 149F depict number of human A) CD45+ cells, B) CD3+ T cells, C) CD8+ T cells, D) CD4+ T cells, and E) NK cells, as well as F) CD8 to CD4 T cell ratio in blood of pp65-MCF7 and huPBMC-engrafted NSG-DKO mice on Day 21 after first dose with indicated test articles. Statistics for cell expansion performed on log-transformed data using unpaired t-test. $p<0.05$ indicates significant difference in expansion.

FIG. 150A-FIG. 150G depict number of human A) CD45+ cells, B) CD3+ T cells, C) CD8+ T cells, D) CD4+ T cells, and E) NK cells, and F) γδ T cells, as well as G) CD8 to CD4 T cell ratio in blood of pp65-MCF7 and huPBMC-engrafted NSG-DKO mice on Day 14 after first dose with indicated test articles. Statistics for cell expansion performed on log-transformed data using unpaired t-test. $p<0.05$ indicates significant difference in expansion.

Figure 151A:
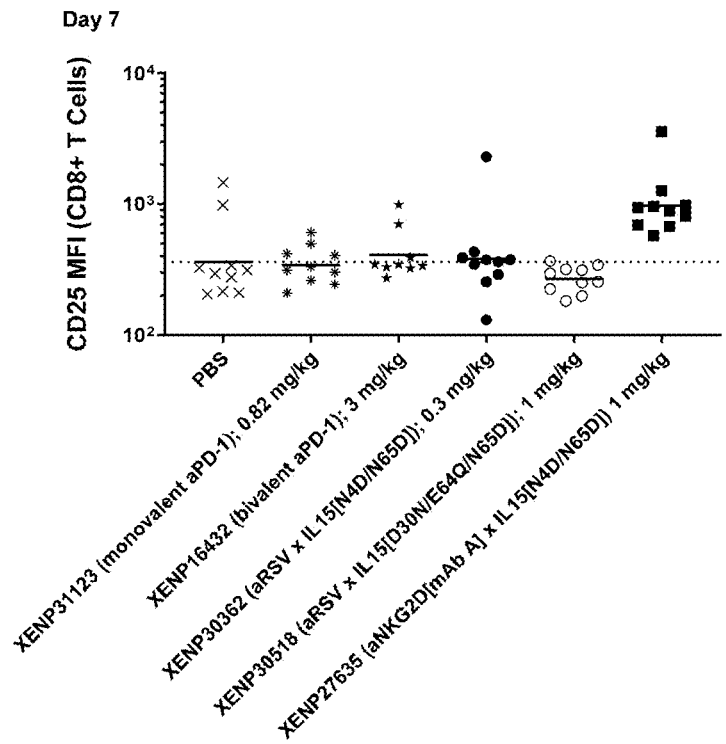
Figure 151B:
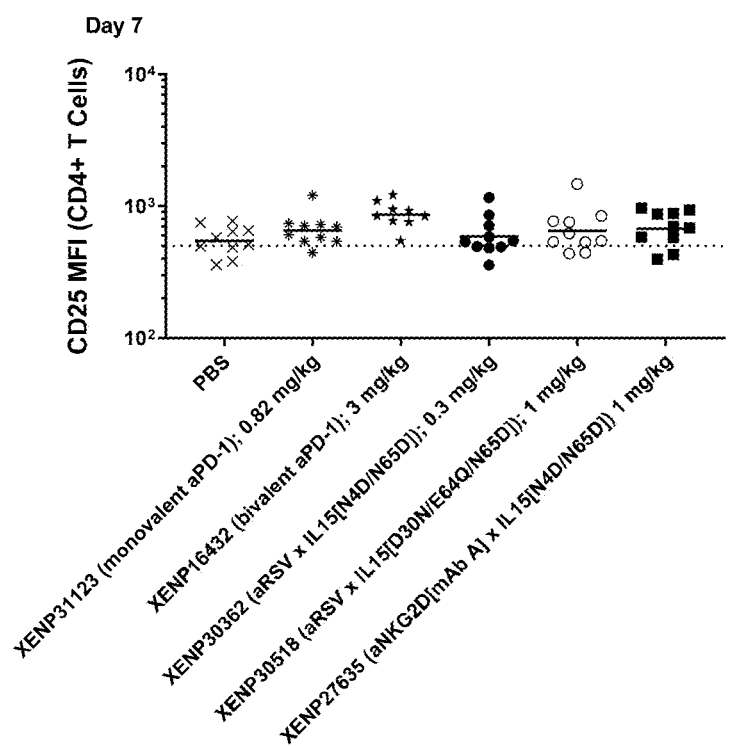

FIG. 151A-FIG. 151B depict expression of CD25 as an indicator of activation on human A) CD8+ cells and B) CD4+ T cells blood of pp65-MCF7 and huPBMC-engrafted NSG-DKO mice on Day 7 after first dose with indicated test articles. The data show that XENP27635 selectively activated CD8+ T cells over CD4+ T cells.

DETAILED DESCRIPTION OF THE INVENTION

I. Nomenclature

The targeted IL-15/RαFc fusion proteins of the invention are listed in several different formats. Each polypeptide is given a unique "XENP" number, although as will be appreciated in the art, a longer sequence might contain a shorter one. Some molecules have three polypeptides, so the XENP number, with the components, is used as a name. Thus, the molecule XENP24116, which is in bottle opener format, comprises three sequences, generally referred to as "XENP24116_human IL15Rα (sushi domain)_(GGGGS)$_5$_human IL15 (N65D; single chain)-Fc", "XENP24116_51.1 [CD8]_H1L1 Fab-Fc heavy chain" and "XENP24116_51.1 [CD8]_H1L1 Fab-Fc light chain" or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab monomer has the full length sequence, the variable heavy sequence and the three CDRs of the variable heavy sequence; the light chain has a full length sequence, a variable light sequence and the three CDRs of the variable light sequence; and the scFv-Fc domain has a full length sequence, an scFv sequence, a variable light sequence, 3 light CDRs, a scFv linker, a variable heavy sequence and 3 heavy CDRs; note that all molecules herein with a scFv domain use a single charged scFv linker (+H), although others can be used. In addition, the naming nomenclature of particular variable domains uses a "Hx.xx_Ly.yy" type of format, with the numbers being unique identifiers to particular variable chain sequences. Thus, the variable domain of the Fab side of XENP26229 is "OKT8_H2.166_L1.103", which indicates that the variable heavy domain H2.166 was combined with the light domain L1.103. In the case that these sequences are used as scFvs, the desgination "OKT8_H2.166_L1.103", indicates that the variable heavy domain H2.166 was combined with the light domain L1.103 and is in the vh-linker-vl orientation, from N- to C-terminus. This molecule with the identical sequence of the heavy and light variable domains but in the reverse order would be named "OKT8_L1.103_H2.166". Similarly, different constructs may "mix and match" the heavy and light chains as will be evident from the sequence listing and the Figures.

II. Definitions

In order that the application may be more completely understood, several definitions are set forth below. Such definitions are meant to encompass grammatical equivalents.

By "ablation" herein is meant a decrease or removal of binding and/or activity. Thus for example, "ablating FcγR binding" means the Fc region amino acid variant has less than 50% starting binding as compared to an Fc region not containing the specific variant, with less than 70-80-90-95-98% loss of binding being preferred, and in general, with the binding being below the level of detectable binding in a Biacore assay. Of particular use in the ablation of FcγR binding are those shown in FIG. 29. However, unless otherwise noted, the Fc monomers of the invention retain binding to the FcRn.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity. As is discussed herein, many embodiments of the invention ablate ADCC activity entirely.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "antigen binding domain" or "ABD" herein is meant a set of six Complementary Determining Regions (CDRs) that, when present as part of a polypeptide sequence, specifically binds a target antigen as discussed herein. Thus, a "NKG2D antigen binding domain" binds a human NKG2D antigen as outlined herein. As is known in the art, these CDRs are generally present as a first set of variable heavy CDRs (vhCDRs or $V_H$CDRs) and a second set of variable light CDRs (vlCDRs or $V_L$CDRs), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. Thus, in some cases, the six CDRs of the antigen binding domain are contributed by a variable heavy and variable light chain. In a "Fab" format, the set of 6 CDRs are contributed by two different polypeptide sequences, the variable heavy domain (vh or $V_H$; containing the vhCDR1, vhCDR2 and vhCDR3) and the variable light domain (vl or $V_L$; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker as outlined herein, into a single polypeptide sequence, which can be either (starting from the N-terminus) vh-linker-vl or vl-linker-vh, with the former being generally preferred (including optional domain linkers on each side, depending on the format used (e.g., from FIG. 1 of U.S. 62/353,511).

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233– or E233#, E233( ) or E233del designates a deletion of glutamic acid at position 233. Additionally, EDA233– or EDA233# designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4. The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it.

Accordingly, by "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference). The modification can be an addition, deletion, or substitution. Substitutions can include naturally occurring amino acids and, in some cases, synthetic amino acids. Examples include U.S. Pat. No. 6,586,207; WO 98/48032;

WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides.

By "residue" as used herein is meant a position in a protein and its associated amino acid identity. For example, asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein.

By "Fv" or "Fv fragment" or "Fv region" as used herein is meant a polypeptide that comprises the VL and VH domains of a single antibody. As will be appreciated by those in the art, these generally are made up of two chains, or can be combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh).

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes.

By "FcRn" or "neonatal Fc Receptor" as used herein is meant a protein that binds the IgG antibody Fc region and is encoded at least in part by an FcRn gene. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants can be used to increase binding to the FcRn receptor, and in some cases, to increase serum half-life. In general, unless otherwise noted, the Fc monomers of the invention retain binding to the FcRn receptor (and, as noted below, can include amino acid variants to increase binding to the FcRn receptor).

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it.

By "Fc" or "Fc region" or "Fc domain" as used herein is meant the polypeptide comprising the constant region of an antibody excluding the first constant region immunoglobulin domain (e.g., CH1) and in some cases, part of the hinge. For IgG, the Fc domain comprises immunoglobulin domains CH2 and CH3 (Cγ2 and Cγ3) and the lower hinge region between CH1 (Cγ1) and CH2 (Cγ2). Although the boundaries of the Fc region may vary, the human IgG heavy chain Fc region is usually defined to include residues C226 or P230 to its carboxyl-terminus, wherein the numbering is according to the EU index as in Kabat. Accordingly, "CH" domains in the context of IgG are as follows: "CH1" refers to positions 118-215 according to the EU index as in Kabat. "Hinge" refers to positions 216-230 according to the EU index as in Kabat. "CH2" refers to positions 231-340 according to the EU index as in Kabat, and "CH3" refers to positions 341-447 according to the EU index as in Kabat. Thus, the "Fc domain" includes the -CH2-CH3 domain, and optionally a hinge domain (hinge-CH2-CH3). In the embodiments herein, when a scFv or IL-15 complex is attached to an Fc domain, it is the C-terminus of the scFv construct that is attached to all or part of the hinge of the Fc domain; for example, it is generally attached to the sequence EPKS (SEQ ID NO: 7) which is the beginning of the hinge. In some embodiments, as is more fully described below, amino acid modifications are made to the Fc region, for example to alter binding to one or more FcγR receptors or to the FcRn receptor, and to enable heterodimer formation and purification, as outlined herein.

By "heavy constant region" herein is meant the CH1-hinge-CH2-CH3 portion of an antibody.

As will be appreciated by those in the art, the exact numbering and placement of the heavy constant region domains can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

|  | EU Numbering | Kabat Numbering |
| --- | --- | --- |
| CH1 | 118-215 | 114-223 |
| Hinge | 216-230 | 226-243 |

TABLE 1-continued

| | EU Numbering | Kabat Numbering |
|---|---|---|
| CH2 | 231-340 | 244-360 |
| CH3 | 341-447 | 361-478 |

By "Fc fusion protein" or "immunoadhesin" herein is meant a protein comprising an Fc region, generally linked (optionally through a linker moiety, as described herein) to a different protein, such as to IL-15 and/or IL-15Rα(sushi), as described herein. In some instances, two Fc fusion proteins can form a homodimeric Fc fusion protein or a heterodimeric Fc fusion protein with the latter being preferred. In some cases, one monomer of the heterodimeric Fc fusion protein comprises an Fc domain alone (e.g., an empty Fc domain) and the other monomer is a Fc fusion, comprising a variant Fc domain and a protein domain, such as a receptor, ligand or other binding partner.

By "position" as used herein is meant a location in the sequence of a protein. Positions may be numbered sequentially, or according to an established format, for example the EU index for antibody numbering.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g., making the pI higher) then steric variants that are "charge pairs" that can be utilized as well do not interfere with the pI variants, e.g., the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "target cell" as used herein is meant a cell that expresses a target antigen, in this case, human CD8, human NKG2A, or human NKG2D.

By "host cell" in the context of producing a targeted IL-15/Rα-Fc fusion protein according to the invention herein is meant a cell that contains the exogeneous nucleic acids encoding the components of the targeted IL-15/Rα-Fc fusion protein and is capable of expressing the targeted IL-15/Rα-Fc fusion protein under suitable conditions. Suitable host cells are discussed below.

By "variable region" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

The CD8-, NKG2A-, or NKG2D-targeted heterodimeric proteins of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated protein," refers to a protein which is substantially free of other proteins having different binding specificities. "Recombinant" means the proteins are generated using recombinant nucleic acid techniques in exogeneous host cells.

"Percent (%) amino acid sequence identity" with respect to a protein sequence is defined as the percentage of amino acid residues in a candidate sequence that are identical with the amino acid residues in the specific (parental) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. One particular program is the ALIGN-2 program outlined at paragraphs [0279] to [0280] of U.S. Pub. No. 20160244525, hereby incorporated by reference.

The degree of identity between an amino acid sequence of the present invention ("invention sequence") and the parental amino acid sequence is calculated as the number of exact matches in an alignment of the two sequences, divided by the length of the "invention sequence," or the length of the parental sequence, whichever is the shortest. The result is expressed in percent identity.

In some embodiments, two or more amino acid sequences are at least 50%, 60%, 70%, 80%, or 90% identical. In some embodiments, two or more amino acid sequences are at least 95%, 97%, 98%, 99%, or even 100% identical.

"Specific binding" or "specifically binds to" or is "specific for" a particular antigen or an epitope (in this case, human NKG2D) means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular molecule or an epitope can be exhibited, for example, by an antigen binding molecule having a $K_D$ for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater. Typically, an antigen binding molecule that specifically binds an antigen will have a $K_D$ that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore assay.

By "fused" or "covalently linked" is herein meant that the components (e.g., an IL-15 protein and an Fc domain) are linked by peptide bonds, either directly or via domain linkers, outlined herein.

Before the invention is further described, it is to be understood that this invention is not limited to particular embodiments described, and as such may, of course, vary. It is also to be understood that the terminology used herein is for the purpose of describing particular embodiments only, and is not intended to be limiting, since the scope of the present invention will be limited only by the appended claims.

III. Targeted IL-15/IL-15Rα x Antigen Binding Domain Heterodimeric Fc Fusion Proteins Provided herein are targeted IL-15/IL-15Rα heterodimeric fusion proteins that can bind to an antigen and can complex with the common gamma chain (γc; CD132) and the IL-2 receptor β-chain (IL-2Rβ; CD122). The heterodimeric fusion proteins can contain an IL-15/IL-15Rα-Fc fusion protein and an antigen binding domain. The IL-15/IL-15Rα-Fc fusion protein can include as IL-15 protein covalently attached to an IL-15Rα, and an Fc domain. Optionally, the IL-15 protein and IL-15Rα protein are noncovalently attached. The antigen binding domain specifically binds to a target antigen, such as, but not limited to, CD8, NKG2A, and NKG2D.

A. Fc Domains

The Fc domain component of the invention is as described herein, which generally contains skew variants and/or optional pI variants and/or ablation variants are outlined herein. See for example the disclosure of WO2017/218707 under the heading "IV Heterodimeric Antibodies", including sections IV.A, IV.B, IV.C, IV.D, IV.E, IV.F, IV.G, IV.H and IV.I, all of which are expressly incorporated by reference in their entirety. Of particular use in the heterodimeric proteins of the present invention are Fc domains containing "skew variants", "pI variants", "ablation variants" and FcRn variants as outlined therein. Particularly useful Fc domains are those shown in FIG. 8A-FIG. 8D. Thus, variant Fc domains derived from IgG1 can be used, as well as IgG4 variants with a S228P variant.

The Fc domains can be derived from IgG Fc domains, e.g., IgG1, IgG2, IgG3 or IgG4 Fc domains, with IgG1 Fc domains finding particular use in the invention. The following describes Fc domains that are useful for IL-15/IL-15Rα Fc fusion monomers and checkpoint antibody fragments of the targeted IL-15/IL-15Rα heterodimer proteins of the present invention.

Thus, the "Fc domain" includes the -CH2-CH3 domain, and optionally a hinge domain, and can be from human IgG1, IgG2, IgG3 or IgG4, with Fc domains derived from IgG1. In some of the embodiments herein, when a protein fragment, e.g., IL-15 or IL-15Rα is attached to an Fc domain, it is the C-terminus of the IL-15 or IL-15Rα construct that is attached to all or part of the hinge of the Fc domain; for example, it is generally attached to the sequence EPKS (SEQ ID NO: 7) which is the beginning of the hinge. In other embodiments, when a protein fragment, e.g., IL-15 or IL-15Rα, is attached to an Fc domain, it is the C-terminus of the IL-15 or IL-15Rα construct that is attached to the CH1 domain of the Fc domain.

In some of the constructs and sequences outlined herein of an Fc domain protein, the C-terminus of the IL-15 or IL-15Rα protein fragment is attached to the N-terminus of a domain linker, the C-terminus of which is attached to the N-terminus of a constant Fc domain (N-IL-15 or IL-15Rα protein fragment-linker-Fc domain-C) although that can be switched (N-Fc domain-linker-IL-15 or IL-15Rα protein fragment-C). In other constructs and sequence outlined herein, C-terminus of a first protein fragment is attached to the N-terminus of a second protein fragment, optionally via a domain linker, the C-terminus of the second protein fragment is attached to the N-terminus of a constant Fc domain, optionally via a domain linker. In yet other constructs and sequences outlined herein, a constant Fc domain that is not attached to a first protein fragment or a second protein fragment is provided. A heterodimer Fc fusion protein can contain two or more of the exemplary monomeric Fc domain proteins described herein.

In some embodiments, the linker is a "domain linker", used to link any two domains as outlined herein together, some of which are depicted in FIG. 6. While any suitable linker can be used, many embodiments utilize a glycine-serine polymer, including for example (GS)n, (GSGGS)n (SEQ ID NO: 8), (GGGGS)n (SEQ ID NO: 9), and (GGGS)n (SEQ ID NO: 10), where n is an integer of at least one (and generally from 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, the linker is a charged domain linker. Accordingly, in some embodiments the present invention provides heterodimeric Fc fusion proteins that rely on the use of two different heavy chain variant Fc sequences, that will self-assemble to form a heterodimeric Fc domain fusion polypeptide.

In one embodiment, heterodimeric Fc fusion proteins contain at least two constant domains which can be engineered to produce heterodimers, such as pI engineering. Other Fc domains that can be used include fragments that contain one or more of the CH1, CH2, CH3, and hinge domains of the invention that have been pI engineered. In particular, the formats depicted in FIGS. 57A-57K are heterodimeric Fc fusion proteins, meaning that the protein has two associated Fc sequences self-assembled into a heterodimeric Fc domain and at least one protein fragment (e.g., 1, 2 or more protein fragments). In some cases, a first protein fragment is linked to a first Fc sequence and a second protein fragment is linked to a second Fc sequence. In some cases, the heterodimeric Fc fusion protein contains a first protein fragment linked to a second protein fragment which is linked to a first Fc sequence, and a second Fc sequence that is not linked to either the first or second protein fragments.

The present invention is directed to novel constructs to provide heterodimeric Fc fusion proteins that allow binding to one or more binding partners, ligands or receptors. The heterodimeric Fc fusion constructs are based on the self-assembling nature of the two Fc domains of the heavy chains of antibodies, e.g., two "monomers" that assemble into a "dimer". Heterodimeric Fc fusions are made by altering the amino acid sequence of each monomer as more fully discussed below. Thus, the present invention is generally directed to the creation of heterodimeric Fc fusion proteins which can co-engage binding partner(s) or ligand(s) or receptor(s) in several ways, relying on amino acid variants in the constant regions that are different on each chain to promote heterodimeric formation and/or allow for ease of purification of heterodimers over the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes described herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric proteins; one relies on the use of pI variants, such that each monomer, and subsequently each dimeric species, has a different pI, thus allowing the isoelectric purification of A-A, A-B and B-B dimeric proteins. Alternatively, some formats also allow separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers and each dimeric species.

Additionally, as more fully outlined below, depending on the format of the heterodimer Fc fusion protein, pI variants can be either contained within the constant and/or Fc domains of a monomer, or domain linkers can be used. That is, the invention provides pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B can be changed, with the pI of monomer A increasing and the pI of monomer B decreasing. As discussed, the pI changes of either or both monomers can be done by removing or adding a charged residue (e.g., a neutral amino acid is replaced by a positively or negatively charged amino acid residue, e.g., glutamine to glutamic acid), changing a charged residue from positive or negative to the opposite charge (e.g. aspartic acid to lysine) or changing a charged residue to a neutral residue (e.g., loss of a charge; lysine to serine). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A:B+ or wt A:B−), or by increasing one region and decreasing the other region (A+:B− or A−:B+).

Thus, in general, a component of some embodiments of the present invention are amino acid variants in the constant regions that are directed to altering the isoelectric point (pI) of at least one, if not both, of the monomers of a dimeric protein by incorporating amino acid substitutions ("pI variants" or "pI substitutions") into one or both of the monomers. The separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components. That is, to determine which monomer to engineer or in which "direction" (e.g., more positive or more negative), the sequences of the Fc domains, and in some cases, the protein domain(s) linked to the Fc domain are calculated and a decision is made from there. As is known in the art, different Fc domains and/or protein domains will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in the Figures, for example, several of the formats allow separation of heterodimers and homodimers on the basis of size.

In the case where pI variants are used to achieve heterodimerization, by using the constant region(s) of Fc domains(s), a more modular approach to designing and purifying heterodimeric Fc fusion proteins is provided. Thus, in some embodiments, heterodimerization variants (including skew and purification heterodimerization variants) must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of Fc fusion proteins, as the ability to either eliminate, minimize and distinguish when homodimers are present is significant. Similarly, the ability to reliably test the reproducibility of the heterodimeric Fc fusion protein production is important.

1. Heterodimerization Variants

The present invention provides heterodimeric proteins, including heterodimeric Fc fusion proteins in a variety of formats, which utilize heterodimeric variants to allow for heterodimer formation and/or purification away from homodimers. The heterodimeric fusion constructs are based on the self-assembling nature of the two Fc domains, e.g., two "monomers" that assemble into a "dimer".

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

2. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in in the FIG. 29 of U.S. Ser. No. 15/141,350, all of which is hereby incorporated by reference in its entirety, as well as in FIGS. 1A-1E.

One mechanism is generally referred to in the art as "knobs and holes", referring to amino acid engineering that creates steric influences to favor heterodimeric formation and disfavor homodimeric formation, as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g., these are "monomer corresponding sets) and C220E/P228E/368E paired with C220R/E224R/P228R/K409R.

Additional monomer A and monomer B variants can be combined with other variants, optionally and independently in any amount, such as pI variants outlined herein or other steric variants that are shown in FIG. 37 of US 2012/0149876, all of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIG. 1A-FIG. 1E. Of particular use in many embodiments are the pairs of sets including, but not limited to, S364K/E357Q:L368D/K370S; L368D/K370S:S364K; L368E/K370S:S364K; T411E/K360E/Q362E:D401K; L368D/K370S:S364K/E357L; K370S:S364K/E357Q and T366S/L368A/Y407V:T366W (optionally including a bridging disulfide, T366S/L368A/Y407V/Y349C:T366W/S354C). In terms of nomenclature, the pair "S364K/E357Q:L368D/K370S" means that one of the monomers has the double variant set S364K/E357Q and the other has the double variant set L368D/K370S; as above, the "strandedness" of these pairs depends on the starting pI.

3. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be used: one monomer may be wild type, or a variant that does not display a significantly different pI from wild-type, and the other can be either more basic or more acidic. Alternatively, each monomer may be changed, one to more basic and one to more acidic.

Preferred combinations of pI variants are shown in FIG. 30 of U.S. Ser. No. 15/141,350, all of which are herein incorporated by reference in its entirety. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, a preferred combination of pI variants has one monomer comprising 208D/295E/384D/418E/421D variants (N208D/Q295E/N384D/Q418E/N421D when relative to human IgG1) if one of the Fc monomers includes a CH1 domain. In some instances, the second monomer comprising a positively charged domain linker, including (GKPGS)$_4$ (SEQ ID NO: 31). In some cases, the first monomer includes a CH1 domain, including position 208. Accordingly, in constructs that do not include a CH1 domain (for example for heterodimeric Fc fusion proteins that do not utilize a CH1 domain on one of the domains), a preferred negative pI variant Fc set includes 295E/384D/418E/421D variants (Q295E/N384D/Q418E/N421D when relative to human IgG1).

In some embodiments, mutations are made in the hinge domain of the Fc domain, including positions 221, 222, 223, 224, 225, 233, 234, 235 and 236. It should be noted that changes in 233-236 can be made to increase effector function (along with 327A) in the IgG2 backbone. Thus, pI mutations and particularly substitutions can be made in one or more of positions 221-225, with 1, 2, 3, 4 or 5 mutations finding use in the present invention. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 274, 296, 300, 309, 320, 322, 326, 327, 334 and 339. Again, all possible combinations of these 10 positions can be made; e.g., a pI antibody may have 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non native threonine at position 339, and all possible combinations within CH2 and with other domains.

In this embodiment, the mutations can be independently and optionally selected from position 355, 359, 362, 384, 389, 392, 397, 418, 419, 444 and 447. Specific substitutions that find use in lowering the pI of CH3 domains include, but are not limited to, a non native glutamine or glutamic acid at position 355, a non-native serine at position 384, a non-native asparagine or glutamic acid at position 392, a non-native methionine at position 397, a non native glutamic acid at position 419, a non native glutamic acid at position 359, a non native glutamic acid at position 362, a non native glutamic acid at position 389, a non native glutamic acid at position 418, a non native glutamic acid at position 444, and a deletion or non-native aspartic acid at position 447. Exemplary embodiments of pI variants are provided in FIG. 2.

4. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. App. No. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant Fc fusion protein. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

5. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US2014/0370013. As discussed herein, which monomer to engineer is generally decided by the inherent pI of each monomer.

6. Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

7. FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, amino acid substitutions that increase affinity for FcγRIIc can also be included in the Fc domain variants outlined herein. The substitutions described in, for example, U.S. Ser. Nos. 11/124,620 and 14/578,305 are useful.

In addition, there are additional Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

8. Ablation Variants

Similarly, another category of functional variants includes "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of bispecific immunomodulatory proteins desirable to ablate FcγRIIIa binding to eliminate or significantly reduce ADCC activity such that one of the Fc domains comprises one or more Fcγ receptor ablation variants. These ablation variants are depicted in FIG. 31 of U.S. Ser. No. 15/141,350, all of which are herein incorporated by reference in its entirety, and each can be independently and optionally included or excluded, with preferred aspects utilizing ablation variants selected from the group consisting of G236R/L328R, E233P/L234V/ L235A/G236del/S239K, E233P/L234V/L235A/G236del/ S267K, E233P/L234V/L235A/G236del/S239K/A327G, E233P/L234V/L235A/G236del/S267K/A327G and E233P/ L234V/L235A/G236del, according to the EU index. It should be noted that the ablation variants referenced herein ablate FcγR binding but generally not FcRn binding.

Exemplary embodiments of pI variants are provided in FIG. 3

9. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, may also be independently and optionally combined with Fc ablation variants, Fc variants, FcRn variants, as generally outlined herein.

In addition, a monomeric Fc domain can comprise a set of amino acid substitutions that includes C220S/S267K/ L368D/K370S or C220S/S267K/S364K/E357Q.

In addition, the heterodimeric Fc fusion proteins can comprise skew variants (e.g., a set of amino acid substitutions as shown in FIGS. 1A-1C of U.S. Ser. No. 15/141,350, all of which are herein incorporated by reference in its entirety), with particularly useful skew variants being selected from the group consisting of S364K/E357Q: L368D/K370S; L368D/K370S:S364K; L368E/K370S: S364K; T411E/Q362E:D401K; L368D/K370S:S364K/ E357L, K370S:S364K/E357Q, T366S/L368A/Y407V: T366W and T366S/L368A/Y407V/Y349C:T366W/S354C, optionally ablation variants, optionally charged domain linkers and the heavy chain comprises pI variants.

In some embodiments, the Fc domain comprising an amino acid substitution selected from the group consisting of: 236R, 239D, 239E, 243L, M252Y, V259I, 267D, 267E, 298A, V308F, 328F, 328R, 330L, 332D, 332E, M428L, N434A, N434S, 236R/328R, 239D/332E, M428L, 236R/ 328F, V259I/V308F, 267E/328F, M428L/N434S, Y436I/ M428L, Y436I/M428L, Y436I/N434S, Y436V/N434S, 239D/332E/330L, M252Y/S254T/T256E, V259I/V308F/ M428L, E233P/L234V/L235A/G236del/S267K, G236R/ L328R and PVA/S267K. In some cases, the Fc domain comprises the amino acid substitution 239D/332E. In other cases, the Fc domain comprises the amino acid substitution G236R/L328R or PVA/S267K.

In one embodiment, a particular combination of skew and pI variants that finds use in the present invention is T366S/ L368A/Y407V:T366W (optionally including a bridging disulfide, T366S/L368A/Y407V/Y349C:T366W/S354C) with one monomer comprises Q295E/N384D/Q418E/N481D and the other a positively charged domain linker. As will be appreciated in the art, the "knobs in holes" variants do not change pI, and thus can be used on either monomer.

IV. IL-15/IL-15Rα-Fc Fusion Monomers

The targeted heterodimeric fusion proteins of the present invention include an IL-15/IL-15 receptor alpha (IL-15Rα)- Fc fusion monomer. In some cases, the IL-15 and IL-15 receptor alpha (IL-15Rα) protein domains are in different orientations. Exemplary embodiments of IL-15/IL-15Rα-Fc fusion monomers are provided in the Figures including but not limited to FIGS. 4A-4E, 5A-5D, and 8A-8D.

In some embodiments, the human IL-15 protein has the amino acid sequence set forth in NCBI Ref Seq. No. NP_000576.1 or SEQ ID NO: 1. In some cases, the coding sequence of human IL-15 is set forth in NCBI Ref Seq. No. NM_000585. An exemplary IL-15 protein of the Fc fusion heterodimeric protein outlined herein can have the amino acid sequence of SEQ ID NO:2 or amino acids 49-162 of SEQ ID NO:1. In some embodiments, the IL-15 protein has at least 90%, e.g., 90%, 91%, 92%, 93%, 94%, 95%, 96%, 97%, 98%, 99%, or more sequence identity to SEQ ID NO:2. In some embodiments, the IL-15 protein has the amino acid sequence set forth in SEQ ID NO:2 and the amino acid substitution N72D. In other embodiments, the IL-15 protein has the amino acid sequence of SEQ ID NO:2 and one or more amino acid substitutions selected from the group consisting of C42S, L45C, Q48C, V49C, L52C, E53C, E87C, and E89C. Optionally, the IL-15 protein also has an N72D substitution. The IL-15 protein of the Fc fusion protein can have 1, 2, 3, 4, 5, 6, 7, 8 or 9 amino acid substitutions. In some embodiments, the human IL-15 protein of the Fc fusion protein comprises the amino acid substitution N4D. In some embodiments, the human IL-15 protein of the Fc fusion protein comprises the amino acid substitution D30N. In some embodiments, the human IL-15 protein of the Fc fusion protein comprises the amino acid substitution N65D. In some embodiments, the human IL-15 protein of the Fc fusion protein comprises amino acid substitutions N4D/N65D. In some embodiments, the human IL-15 protein of the Fc fusion protein comprises amino acid substitutions D30N/N65D. In some embodiments, the human IL-15 protein of the Fc fusion protein comprises amino acid substitutions D30N/E64Q/N65D.

In some embodiments, the human IL-15 protein of the Fc fusion protein is identical to the amino acid sequence of SEQ ID NO:2. In some cases, the human IL-15 protein has no amino acid substitutions.

In other embodiments, the amino acid substitution(s) may be isosteric substitutions at the IL-15:IL-2β and IL-15: common gamma chain interface.

In some embodiments, the human IL-15 variant comprises an amino acid substitution at position N65 of SEQ ID NO:2 and further comprising one or more amino acid substitutions at positions N1, N4, D8, D30, D61, E64, and/or Q108 of SEQ ID NO:2. In some instances, the IL-15 variant comprises amino acid substitutions at positions selected from the group consisting of: a) N1 and N65; b) N4 and N65; c) D30 and N65; d) E64 and N65; e) N65 and Q108; f) N1, N4, and N65; g) N4, D61, and N65; and h) D30, E64, and N65. In some embodiments, the amino acid substitutions of the IL-15 variant are selected from the group consisting of: a) N1D and N65D; b) N4D and N65D; c) D30N and N65D; d) E64Q and N65D; e) N65D and Q108E; f) N1D, N4D, and N65D; g) N4D, D61N, and N65D; and h) D30N, E64Q, and N65D.

In some embodiments, the human IL-15 variant comprises an amino acid substitution at position E64 of SEQ ID NO:2 and further comprising one or more amino acid substitutions at positions N1, N4, D8, D30, D61, N65, and/or Q108 of SEQ ID NO:2. In some instances, the IL-15 variant comprises amino acid substitutions at positions selected from the group consisting of: a) N1 and E64; b) N4 and E64; c) D8 and E64; d) D61 and E64; e) E64 and N65; f) E64 and Q108; g) D30, E64, and N65; h) D61, E64, and N65; i) N1, D61, E64, and Q108; and j) N4, D61, E64, and Q108. In some embodiments, the amino acid substitutions of the IL-15 variant are selected from the group consisting of: a) N1D and E64Q; b) N4D and E64Q; c) D8N and E64Q; d) D61N and E64Q; e) E64Q and N65D; f) E64Q and Q108E; g) D30N, E64Q, and N65D; h) D61N, E64Q, and N65D; i) N1D, D61N, E64Q, and Q108E; and j) N4D, D61N, E64Q, and Q108E.

In some embodiments, the human IL-15 variant comprises an amino acid substitution at position D61 of SEQ ID NO:2 and further comprising one or more amino acid substitutions at positions N1, N4, D8, D30, E64, N65, and/or Q108 of SEQ ID NO:2. In some instances, the IL-15 variant comprises amino acid substitutions at positions selected from the group consisting of: a) N1 and D61; b) N4 and D61; c) D8 and D61; d) D61 and E64; e) D61, E64, and N65; f) N1, D61, E64, and Q108; g) N4, D61, E64, and Q108; and h) N4, D61, and N65. In some embodiments, the amino acid substitutions of the IL-15 variant are selected from the group consisting of: a) N1D and D61N; b) N4D and D61N; c) D8N and D61N; d) D61N and E64Q; e) D61N, E64Q, and N65D; f) N1D, D61N, E64Q, and Q108E; g) N4D, D61N, E64Q, and Q108E; and h) N4D, D61N, and N65D.

In some embodiments, the human IL-15 variant having a sequence of SEQ ID NO:2 and has one or more amino acid substitutions selected from the group consisting of N1D, N4D, D8N, D30N, D61N, E64Q, N65D, Q108E, and any combination thereof. In some embodiments, the IL-15 protein has the amino acid substitution Q108E. In some cases, the IL-15 protein has 1, 2, 3, 4, 5, 6, 7, 8, or more amino acid substitutions. The IL-15 protein can have a N1D, N4D, D8N, D30N, D61N, E64Q, N65D, or Q108E substitution. In some embodiments, the amino acid substitution can include D30N, N1D/D30N, N1D/D61N, N1D/E64Q, N4D/D30N, N4D/D61N, N4D/E64Q, N4D/N65D, D8N/D61N, D8N/E64Q, D30N/E64Q, D30N/N65D, D30N/E64Q/N65D, D61N/E64Q, E64Q/Q108E, N1D/N4D/D8N, D30N/E64Q/N65D, D61N/E64Q/N65D, N1D/D61N/E64Q, N1D/D61N/E64Q/Q108E, or N4D/D61N/E64Q/Q108E. In some embodiments, the IL-15 protein has the amino acid substitution N4D. In certain embodiments, the IL-15 protein has the amino acid substitution N65D. In certain embodiments, the IL-15 protein has the amino acid substitution D30N. In some embodiments, the IL-15 protein has the amino acid substitutions N4D/N65D. In some embodiments, the IL-15 protein has the amino acid substitutions N1D/D30N. In some embodiments, the IL-15 protein has the amino acid substitutions N4D/D30N. In some embodiments, the IL-15 protein has the amino acid substitutions N4D/N65D. In some embodiments, the IL-15 protein has the amino acid substitutions D30N/E64Q. In some embodiments, the IL-15 protein has the amino acid substitutions D30N/N65D. In some embodiments, the IL-15 protein has the amino acid substitutions D30N/E64Q/N65D. In some embodiments, the IL-15 variant of the NKG2D targeted IL-15/Rα-Fc fusion protein provided herein has an amino acid substitution(s) set forth in FIG. 38A.

In some embodiments, the human IL-15 receptor alpha (IL-15Rα) protein has the amino acid sequence set forth in NCBI Ref. Seq. No. NP_002180.1 or SEQ ID NO:3. In some cases, the coding sequence of human IL-15Rα is set forth in NCBI Ref Seq. No. NM_002189.3. An exemplary the IL-15Rα protein of the Fc fusion heterodimeric protein outlined herein can comprise or consist of the sushi domain of SEQ ID NO:3 (e.g., amino acids 31-95 of SEQ ID NO:3), or in other words, the amino acid sequence of SEQ ID NO:4. In some embodiments, the IL-15Rα protein has the amino acid sequence of SEQ ID NO:4 and an amino acid insertion selected from the group consisting of D96, P97, A98, D96/P97, D96/C97, D96/P97/A98, D96/P97/C98, and D96/C97/A98, wherein the amino acid position is relative to full-length human IL-15Rα protein or SEQ ID NO:3. For instance, amino acid(s) such as D (e.g., Asp), P (e.g., Pro), A (e.g., Ala), DP (e.g., Asp-Pro), DC (e.g., Asp-Cys), DPA (e.g., Asp-Pro-Ala), DPC (e.g., Asp-Pro-Cys), or DCA (e.g., Asp-Cys-Ala) can be added to the C-terminus of the IL-15Rα protein of SEQ ID NO:4. In some embodiments, the IL-15Rα protein has the amino acid sequence of SEQ ID NO:4 and one or more amino acid substitutions selected from the group consisting of K34C, A37C, G38C, S40C, and L42C, wherein the amino acid position is relative to SEQ ID NO:4. The IL-15Rα protein can have 1, 2, 3, 4, 5, 6, 7, 8 or more amino acid mutations (e.g., substitutions, insertions and/or deletions).

SEQ ID NO:1 (human IL-15 precursor) is

MRISKPHLRSISIQCYLCLLLNSHFLTEAGIHVFILGCFSAGLPKTEANWV

NVISDLKKIEDLIQSMHIDATLYTESDVHPSCKVTAMKCFLLELQVISLES

GDASIHDTVENLIILANNSLSSNGNVTESGCKECEELEEKNIKEFLQSFVH

IVQMFINTS.

SEQ ID NO:2 (human IL-15 mature form) is

NWVNVISDLKKIEDLIQSMHIDATLYTESDVHPSCKVTAMKCFLLELQVIS

LESGDASIHDTVENLIILANNSLSSNGNVTESGCKECEELEEKNIKEFLQS

FVHIVQMFINTS.

SEQ ID NO:3 (human IL-15 receptor alpha) is

MAPRRARGCRTLGLPALLLLLLLRPPATRGITCPPPMSVEHADIWVKSYSL

YSRERYICNSGFKRKAGTSSLTECVLNKATNVAHWTTPSLKCIRDPALVHQ

RPAPPSTVTTAGVTPQPESLSPSGKEPAASSPSSNNTAATTAAIVPGSQLM

PSKSPSTGTTEISSHESSHGTPSQTTAKNWELTASASHQPPGVYPQGHSDT

TVAISTSTVLLCGLSAVSLLACYLKSRQTPPLASVEMEAMEALPVTWGTSS

RDEDLENCSHHL.

SEQ ID NO:4 (human IL-15 receptor alpha, sushi domain) is

ITCPPPMSVEHADIWVKSYSLYSRERYICNSGFKRKAGTSSLTECVLNKAT

NVAHWTTPSLKCIR.

In some embodiments, an IL-15 protein is attached to the N-terminus of an Fc domain, and an IL-15Rα protein is attached to the N-terminus of the IL-15 protein. In other embodiments, an IL-15Rα protein is attached to the N-terminus of an Fc domain and the IL-15Rα protein is non-covalently attached to an IL-15 protein. In yet other embodiments, an IL-15Rα protein is attached to the C-terminus of an Fc domain and the IL-15Rα protein is non-covalently attached to an IL-15 protein.

In some embodiments, the IL-15 protein and IL-15Rα protein are attached together via a linker. Optionally, the proteins are not attached via a linker. In other embodiments, the IL-15 protein and IL-15Rα protein are noncovalently attached. In some embodiments, the IL-15 protein is attached to an Fc domain via a linker. In other embodiments, the IL-15Rα protein is attached to an Fc domain via a linker. Optionally, a linker is not used to attach the IL-15 protein or IL-15Rα protein to the Fc domain.

In some instances, the immune checkpoint ABD is covalently attached to the N-terminus of an Fc domain via a linker, such as a domain linker.

In some embodiments, the linker is a "domain linker", used to link any two domains as outlined herein together. While any suitable linker can be used, many embodiments utilize a glycine-serine polymer, including for example (GS)n, (GSGGS)n (SEQ ID NO: 8), (GGGGS)n (SEQ ID NO: 9), and (GGGS)n (SEQ ID NO: 10), where n is an integer of at least 1 (and generally from 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers can be used as discussed herein and shown in FIGS. 6 and 7.

V. Antigen Binding Domain Monomers

Therapeutic strategies focused on CD8+ T cell proliferation and activation may provide great promise in the clinic for the treatment of cancer. Cancer can be considered as an inability of the patient to recognize and eliminate cancerous cells. In many instances, these transformed (e.g., cancerous) cells counteract immunosurveillance. There are natural control mechanisms that limit T-cell activation in the body to prevent unrestrained T-cell activity, which can be exploited by cancerous cells to evade or suppress the immune response. Restoring the capacity of immune effector cells—especially T cells—to recognize and eliminate cancer is the goal of immunotherapy. The field of immuno-oncology, sometimes referred to as "immunotherapy" is rapidly evolving, with several recent approvals of T cell checkpoint inhibitory antibodies such as Yervoy®, Keytruda® and Opdivo®. It is generally understood that a variety of immunomodulatory signals, both costimulatory and coinhibitory, can be used to orchestrate an optimal antigen-specific immune response.

The present invention relates to the generation of targeted heterodimeric proteins that bind to immune cells such as CD8+ T cells or NK cells and/or cells expressing IL-2Rβ and the common gamma chain (γc; CD132). The targeted heterodimeric protein can include an antigen binding monomer of any useful antibody format that can bind to an immune antigen or immune cell. In some embodiments, the antigen binding monomer includes a Fab or a scFv linked to an Fc domain.

A. Target Antigens

The targeted heterodimeric proteins of the present invention have at least one antigen binding domain (ABD) that binds to a target antigen fused to an Fc domain, and an IL-15/IL-15Rα protein domain fused in a different Fc domain. Suitable target antigens include human (and sometimes cyno) NKG2D. In some embodiments, two different ABDs that bind to two different target antigens ("target pairs") are present, in either bivalent, bifunctional formats or trivalent, bifunctional formats. Accordingly, non-limiting examples of suitable bifunctional ABDs bind CD8 and NKG2D, or NKG2A and NKG2D, or NKG2D and other target antigen. In yet other embodiments, the targeted heterodimeric proteins have two different antigen binding domains (ABDs) that bind to the same target antigens ("target pairs"), in either bivalent, bifunctional formats or trivalent, bifunctional formats, and an IL-15/IL-15Rα protein domain fused to one of the Fc domains of the protein.

The ABD can be in a variety of formats, such as in a Fab format or in an scFv format. Exemplary ABDs for use in the present invention are disclosed in U.S. 62/353,511, the contents are hereby incorporated in its entirety for all purposes.

In some embodiments, one of the ABDs binds NKG2D. Suitable ABDs that bind NKG2D are shown in FIG. 59 (XENP24365) of PCT/US2018/040653 and FIG. 117A-FIG. 117C provided herein. As will be appreciated by those in the art, suitable ABDs can comprise a set of 6 CDRs as depicted in these Figures, as they are underlined.

In addition, the antibodies of the invention include those that bind to either the same epitope as the antigen binding domains outlined herein, or compete for binding with the antigen binding domains outlined herein. In some embodiments, the bifunctional checkpoint antibody can contain one of the ABDs outlined herein and a second ABD that competes for binding with one of the ABDs outlined herein. In some embodiments both ABDs compete for binding with the corresponding ABD outlined herein. Binding competition is generally determined using Biacore assays as outlined herein.

As will be appreciated by those in the art and discussed more fully below, the heterodimeric fusion proteins of the present invention can take on a wide variety of configurations, as are generally depicted in FIG. 1 of U.S. 62/353,511. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. See, FIG. 57A-FIG. 57K. Thus, the present invention is directed to novel immunoglobulin compositions that co-engage an immune antigen and an IL-15/IL-15Rα binding partner.

B. Antibodies

As is discussed below, the term "antibody" is used generally. Antibodies that find use in the present invention can take on a number of formats as described herein, including traditional antibodies as well as antibody derivatives, fragments and mimetics, described herein and depicted in the figures. In some embodiments, the present invention provides antibodyfusion proteins containing an antigen binding domain and an Fc domain. In some embodiments, the antibody fusion protein forms a bifunctional targeted heterodimeric protein with an IL-15/IL-15Rα Fc fusion protein described herein. Exemplary formats of such bifunctional targeted heterodimeric proteins include, but are not limited to, those depicted in FIG. 57A-FIG. 57K.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to antibodies or antibody fragments (antibody monomers) that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

In addition, many of the sequences herein have at least one the cysteines at position 220 replaced by a serine; generally this is the on the "scFv monomer" side for most of the sequences depicted herein, although it can also be on the "Fab monomer" side, or both, to reduce disulfide formation. Specifically included within the sequences herein are one or both of these cysteines replaced (C220S).

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publ. Appl. No. 2009/0163699, incorporated by reference, the present invention covers pI engineering of IgG1/G2 hybrids.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vlCDRs (e.g. vlCDR1, vlCDR2 and vlCDR3). A useful comparison of CDR numbering is as below, see Lafranc et al., Dev. Comp. Immunol. 27(1):55-77 (2003).

region" or "hinge domain" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (P230 in IgG1), wherein the numbering is according to the EU index as in Kabat. In some cases, a "hinge fragment" is used, which contains fewer amino acids at either or both of the N- and C-termini of the hinge domain. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined above, is the Fc region.

The present invention provides a large number of different CDR sets. In this case, a "full CDR set" comprises the three variable light and three variable heavy CDRs, e.g., a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

TABLE 2

|  | Kabat + Chothia | IMGT | Kabat | AbM | Chothia | Contact | Xencor |
| --- | --- | --- | --- | --- | --- | --- | --- |
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

Another type of Ig domain of the heavy chain is the hinge region. By "hinge" or "hinge region" or "antibody hinge Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

Thus, the present invention provides different antibody domains. As described herein and known in the art, the heterodimeric antibodies of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

Thus, the "Fc domain" includes the -CH2-CH3 domain, and optionally a hinge domain (—H-CH2-CH3). In the embodiments herein, when a scFv is attached to an Fc domain, it is the C-terminus of the scFv construct that is attached to all or part of the hinge of the Fc domain; for example, it is generally attached to the sequence EPKS (SEQ ID NO: 7) which is the beginning of the hinge. The heavy chain comprises a variable heavy domain and a constant domain, which includes a CH1-optional hinge-Fc domain comprising a CH2-CH3. The light chain comprises a variable light chain and the light constant domain. A scFv comprises a variable heavy chain, an scFv linker, and a variable light domain. In most of the constructs and sequences outlined herein, the C-terminus of the variable heavy chain is attached to the N-terminus of the scFv linker, the C-terminus of which is attached to the N-terminus of a variable light chain (N-vh-linker-vl-C) although that can be switched (N-vl-linker-vh-C).

Some embodiments of the invention comprise at least one scFv domain, which, while not naturally occurring, generally includes a variable heavy domain and a variable light domain, linked together by a scFv linker. As outlined herein, while the scFv domain is generally from N- to C-terminus oriented as vh-scFv linker-vl, this can be reversed for any of the scFv domains (or those constructed using vh and vl sequences from Fabs), to vl-scFv linker-vh, with optional linkers at one or both ends depending on the format (see generally FIG. 57A-FIG. 57K.

In some embodiments, the variable heavy domain and variable light domain pair for use in a NKG2D-targeted IL-15/Rα-Fc fusion protein of the invention is selected from any one of the variable heavy domain and variable light domain pair described herein including in the Figures and sequence listing, including the variable heavy domain and variable light domain pair of 1D7B4 (e.g., 1D7B4[NKG2D]_H1 and 1D7B4[NKG2D]_L1), the variable heavy domain and variable light domain pair of KYK-1.0 (e.g., KYK-1.0[NKG2D]H1 and KYK-1.0[NKG2D]_L1), the variable heavy domain and variable light domain pair of KYK-2.0 (e.g., KYK-2.0[NKG2D]_H0 and KYK-2.0 [NKG2D]_L0), the variable heavy domain and variable light domain pair of 11B2D10 (e.g., 11B2D10[NKG2D]_H0 and 11B2D10[NKG2D]_L0), the variable heavy domain and variable light domain pair of 6E5A7 (e.g., 6E5A7 [NKG2D]_H0 and 6E5A7[NKG2D]_L0), the variable heavy domain and variable light domain pair of mAb E (e.g., mAb E[NKG2D]_H1 and mAb E[NKG2D]_L1), the variable heavy domain and variable light domain pair of 16F31 (e.g., 16F31[NKG2D]_ H1 and 16F31[NKG2D]_L1), the variable heavy domain and variable light domain pair of mAb D (e.g., mAb D[NKG2D]_H1 and mAb D[NKG2D]_ L1), and the variable heavy domain and variable light domain pair of 1D7B4 (e.g., 1D7B4[NKG2D]_H1 and 1D7B4[NKG2D]_L1), as shown in FIG. 117A-FIG. 117B, the corresponding SEQ ID NOS and sequence identifiers. In some embodiments, the variable heavy domain and variable light domain pair is a variable heavy domain selected from the group consisting of mAb A_H1 and mAb A_H2, and a variable light domain selected from the group consisting of mAb A_L1 and mAb A_L2, as shown in FIG. 117, the corresponding SEQ ID NOS and sequence identifiers. In some embodiments, the variable heavy domain and variable light domain pair is selected from mAb A_H1L1, mAb A_H1L2, mAb A_H2L1, or mAb A_H2L2. In various embodiments, the variable heavy domain and variable light domain pair is a variable heavy domain selected from the group consisting of mAb B_H1, mAb B_H2, and mAb B_H3, and a variable light domain selected from the group consisting of mAb B_L1, mAb B_L1.1, and mAb B_L2, as shown in FIG. 117B, the corresponding SEQ ID NOS and sequence identifiers. In some embodiments, the variable heavy domain and variable light domain pair is selected from mAb B_H1L1, mAb B_H1L1.1, mAb B_H1L2, mAb B_H2L1, mAb B_H2L1.1, mAb B_H2L2, mAb B_H3L1, mAb B_H3L1.1, or mAb B_H3L2. In certain embodiments, the variable heavy domain and variable light domain pair is a variable heavy domain selected from the group consisting of mAb C_H1 and mAb C_H2, and a variable light domain selected from the group consisting of mAb C_L1 and mAb C_L2, as shown in FIG. 117C, the corresponding SEQ ID NOS and sequence identifiers. In some embodiments, the variable heavy domain and variable light domain pair is selected from mAb C_H1L1, mAb C_H1L2, mAb C_H2L1, or mAb C_H2L2, as shown in FIG. 117C, the corresponding SEQ ID NOS and sequence identifiers.

As shown herein, there are a number of suitable linkers (for use as either domain linkers or scFv linkers) that can be used to covalently attach the recited domains, including traditional peptide bonds, generated by recombinant techniques. In some embodiments, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 8), (GGGGS)n (SEQ ID NO: 9), and (GGGS)n (SEQ ID NO: 10), where n is an integer of at least one (and generally from 3 to 4), glycine-alanine polymers, alanine-serine polymers, and other flexible linkers. Illustrative domain linkers are depicted in FIG. 6. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers.

Other linker sequences may include any sequence of any length of CL/CH1 domain but not all residues of CL/CH1 domain; for example, the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g., TCR, FcR, KIR), hinge region-derived sequences, and other natural sequences from other proteins.

In some embodiments, the linker is a "domain linker", used to link any two domains as outlined herein together. For example, there may be a domain linker that attaches the C-terminus of the CH1 domain of the Fab to the N-terminus of the scFv, with another optional domain linker attaching the C-terminus of the scFv to the CH2 domain (although in many embodiments the hinge is used as this domain linker). While any suitable linker can be used, many embodiments utilize a glycine-serine polymer as the domain linker, including for example (GS)n, (GSGGS)n (SEQ ID NO: 8), (GGGGS)n (SEQ ID NO: 9), and (GGGS)n (SEQ ID NO: 10), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used.

In some embodiments, the linker is a scFv linker, used to covalently attach the vh and vl domains as discussed herein. Accordingly, the present invention further provides charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well can be used in any embodiment herein where a linker is utilized. In particular, the formats depicted in FIG. 57A-FIG. 57K comprise antigen binding proteins, usually referred to as "heterodimeric Fc fusion proteins", meaning that the protein has at least two associated Fc sequences self-assembled into a heterodimeric Fc domain and at least one or more Fv regions, whether as Fabs or as scFvs.

VI. Useful Embodiments of the Invention

As shown in Figures FIG. 57A-FIG. 57K, there are a number of useful formats of the targeted heterodimeric fusion proteins of the invention. In general, the heterodimeric fusion proteins of the invention have three functional components: an IL-15/IL-15Rα(sushi) component, an NKG2D antigen binding domain component, and an Fc component, each of which can take different forms as outlined herein and each of which can be combined with the other components in any configuration.

The first and the second Fc domains can have a set of amino acid substitutions selected from the group consisting of a) S267K/L368D/K370S:S267K/S364K/E357Q; b) S364K/E357Q:L368D/K370S; c) L368D/K370S/S364K; d) L368E/K370S:S364K; e) T411E/K360E/Q362E:D401K; f) L368D/K370S:S364K/E357L and g) K370S:S364K/E357Q, according to EU numbering.

In some embodiments, the first and/or the second Fc domains have an additional set of amino acid substitutions comprising Q295E/N384D/Q418E/N421D, according to EU numbering.

Optionally, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

Optionally, the first and/or second Fc domains have 428L/434S variants for half life extension.

A. scIL-15/Rα x scFv

One embodiment is shown in FIG. 57A, and comprises two monomers. The first monomer comprises, from N- to C-terminus, the sushi domain-domain linker-IL-15-domain linker-CH2-CH3, and the second monomer comprises vh-scFv linker-vl-hinge-CH2-CH3 or vl-scFv linker-vh-hinge-CH2-CH3, although in either orientation a domain linker can be substituted for the hinge. This is generally referred to as "scIL-15/Rα X scFv", with the "sc" standing for "single chain" referring to the attachment of the IL-15 and sushi domain using a covalent linker.

Referring to FIG. 57A, the scIL-15/Rα x scFv format comprises IL-15Rα(sushi) fused to IL-15 by a variable length linker (termed "scIL-15/Rα") which is then fused to the N-terminus of a heterodimeric Fc-region, with an scFv fused to the other side of the heterodimeric Fc.

In some embodiments, the targeted IL-15/Rα-Fc fusion protein comprises: (a) a first monomer comprising, from N- to C-terminal: i) an IL-15 sushi domain; ii) a first domain linker; iii) a variant IL-15 domain; iv) a second domain linker; v) a first variant Fc domain comprising CH2-CH3; and (b) a second monomer comprising, from N- to C-terminal: i) a scFv domain; ii) a third domain linker; iii) a second variant Fc domain comprising CH2-CH3; wherein the scFv domain comprises a first variable heavy domain, an scFv linker and a first variable light domain, and the scFv domain binds human NKG2D. In certain embodiments, the targeted IL-15/Rα-Fc fusion protein comprises: (a) a first monomer comprising, from N- to C-terminal: i) an IL-15 sushi domain; ii) a first domain linker; iii) a variant IL-15 domain; iv) a second domain linker; v) a first variant Fc domain comprising CH2-CH3; and (b) a second monomer comprising, from N- to C-terminal: i) a scFv domain; ii) a third domain linker; iii) a second variant Fc domain comprising CH2-CH3; wherein the scFv domain comprises a first variable heavy domain, an scFv linker and a first variable light domain, and the scFv domain binds human NKG2D.

In the scIL-15/RαX scFv format, one preferred embodiment utilizes the anti-NKG2D ABD having any of the variable heavy and light domain pairs as shown in FIG. 117A-FIG. 117C.

In the scIL-15/RαX scFv format, one preferred embodiment utilizes the anti-NKG2D ABD having the variable heavy and light domain pair selected from the group consisting of MS [NKG2D]_H0L0, KYK-1.0[NKG2D]_H1L1, KYK-2.0[NKG2D]H0L0, 1D7B4[NKG2D]_H1L1, 6E5A7

[NKG2D]_H0L0, 6H7E7[NKG2D]_H0L0, 11B2D10 [NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C.

In the scIL-15/Rα X scFv format, one preferred embodiment utilizes the anti-NKG2D ABD having the variable heavy and light domain pair selected from the group consisting of MS [NKG2D]_H0L0, KYK-1.0[NKG2D]_H1L1, KYK-2.0[NKG2D]H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q: L368D/K370S.

In the scIL-15/RαX scFv format, one preferred embodiment utilizes the anti-NKG2D ABD having the variable heavy and light domain pair selected from the group consisting of MS[NKG2D]_H0L0, KYK-1.0[NKG2D]_H1L, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q: L368D/K370S with either the IL-15 N4D/N65D variant or the IL-15 D30N/N65D variant or the IL-15 D30N/E64Q/N65D variant.

In the scIL-15/Rα X scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant, and with appropriate cysteine substitutions.

In the scIL-15/Rα X scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the scIL-15/Rα X scFv format, one preferred embodiment utilizes the anti-NKG2D ABD having the variable heavy and light domain pair selected from the group consisting of MS [NKG2D]_H0L0, KYK-1.0[NKG2D]_H1L1, KYK-2.0[NKG2D]H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57A format: e.g., the skew variants S364K/E357Q (on the anti-NKG2D monomer) and L368D/K370S (on the IL-15 complex monomer), the pI variants Q295E/N384D/Q418E/N421D (on the IL-15 complex side), the ablation variants E233P/L234V/L235A/ G236_/S267K on both monomers, and optionally the 428L/ 434S variants on both sides. In such embodiments, the format includes an IL-15 N4D/N65D variant or an IL-15 D30N/N65D variant or an IL-15 D30N/E64Q/N65D variant.

In the scIL-15/Rα X scFv format, one preferred embodiment utilizes the anti-NKG2D ABD having the variable heavy and light domain pair selected from the group consisting of MS [NKG2D]_H0L0, KYK-1.0[NKG2D]_H1L1, KYK-2.0[NKG2D]H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57A format: e.g., the skew variants S364K/E357Q (on the IL-15 complex monomer) and L368D/K370S (on anti-NKG2D monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

B. scFv x ncIL-15/Rα

This embodiment is shown in FIG. 57B, and comprises three monomers. The first monomer comprises, from N- to C-terminus, the sushi domain-domain linker-CH2-CH3, and the second monomer comprises vh-scFv linker-vl-hinge-CH2-CH3 or vl-scFv linker-vh-hinge-CH2-CH3, although in either orientation a domain linker can be substituted for the hinge. The third monomer is the IL-15 domain. This is generally referred to as "ncIL-15/Rα X scFv" or "scFv X ncIL-15/Rα" with the "nc" standing for "non-covalent" referring to the self-assembling non-covalent attachment of the IL-15 and sushi domain.

Referring to FIG. 57B, the scFv x ncIL-15/Rα format comprises an scFv fused to the N-terminus of a heterodimeric Fc-region, with IL-15Rα(sushi) fused to the other side of the heterodimeric Fc, while IL-15 is transfected separately so that a non-covalent IL-15/Rα complex is formed.

In the ncIL-15/RαX scFv format, one preferred embodiment utilizes the skew variant pair S364K/E357Q:L368D/K370S. In the ncIL-15/Rα X scFv format, one preferred embodiment utilizes the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In some embodiments, the heterodimeric protein comprises: (a) a first monomer comprising, from N- to C-terminus: i) an IL-15 sushi domain; ii) a first domain linker; iii) a first variant Fc domain comprising CH2-CH3; (b) a second monomer comprising, from N- to C-terminus: i) a scFv domain; ii) a second domain linker; iii) a second variant Fc domain comprising CH2-CH3; wherein said scFv domain comprises a first variable heavy domain, an scFv linker and a first variable light domain; and c) a third monomer comprising a variant IL-15 domain, wherein said scFv domain binds human NKG2D.

In the ncIL-15/RαX scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C.

In the ncIL-15/Rα X scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant.

In the ncIL-15/RαX scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant, and with appropriate cysteine substitutions.

In the ncIL-15/RαX scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S.

In the ncIL-15/Rα X scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the ncIL-15/Rα X scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57B format: e.g., the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

C. scFv x dsIL-15/Rα

This embodiment is shown in FIG. 57C, and comprises three monomers. The first monomer comprises, from N- to C-terminus, the sushi domain-domain linker-CH2-CH3, wherein the sushi domain has an engineered cysteine residue and the second monomer comprises vh-scFv linker-vl-hinge-CH2-CH3 or vl-scFv linker-vh-hinge-CH2-CH3, although in either orientation a domain linker can be substituted for the hinge. The third monomer is the IL-15 domain, also engineered to have a cysteine variant amino acid, thus allowing a disulfide bridge to form between the sushi domain and the IL-15 domain. This is generally referred to as "scFv X dsIL-15/Rα" or dsIL-15/Rα X scFv, with the "ds" standing for "disulfide".

Referring to FIG. 57C, the scFv x dsIL-15/Rαformat comprises an scFv fused to the N-terminus of a heterodimeric Fc-region, with IL-15Rα(sushi) fused to the other side of the heterodimeric Fc, while IL-15 is transfected separately so that a covalent IL-15/Rαcomplex is formed as a result of engineered cysteines.

In the scFv x dsIL-15/Rαformat, one preferred embodiment utilizes the skew variant pair S364K/E357Q:L368D/K370S. In the scFv x dsIL-15/Rα format, one preferred embodiment utilizes the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In some embodiments, the heterodimeric protein comprises: (a) a first monomer comprising, from N- to C-terminus: i) a variant IL-15 sushi domain with a cysteine residue; ii) a first domain linker; iii) a first variant Fc domain comprising CH2-CH3; (b) a second monomer comprising, from N- to C-terminus: i) a scFv domain; ii) a second domain linker; iii) a second variant Fc domain comprising CH2-CH3; wherein the scFv domain comprises a first variable heavy domain, an scFv linker and a first variable light domain; and c) a third monomer comprising a variant IL-15 domain comprising a cysteine residue; wherein the variant IL-15 sushi domain and the variant IL-15 domain form a disulfide bond and the scFv domain binds human NKG2D.

In the dsIL-15/Rα X scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C.

In the dsIL-15/Rα X scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant.

In the dsIL-15/Rα X scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant, and with appropriate cysteine substitutions.

In the dsIL-15/RαX scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S.

In the dsIL-15/RαX scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the dsIL-15/RαX scFv format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57C format: e.g., the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

D. scIL-15/Rα x Fab

This embodiment is shown in FIG. 57D, and comprises three monomers. The first monomer comprises, from N- to C-terminus, the sushi domain-domain linker-IL-15-domain linker-CH2-CH3 and the second monomer comprises a heavy chain, VH-CH1-hinge-CH2-CH3. The third monomer is a light chain, VL-CL. This is generally referred to as "scIL-15/RαX Fab", with the "sc" standing for "single chain".

Referring FIG. 57D, the scIL-15/Rαx Fab (or Fab x scIL-15/Rα) format comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH.

In the scIL-15/Rα X Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, the corresponding SEQ ID NOS, and sequence identifiers described herein in the sequence listing and FIG. 117A-FIG. 117C.

In the scIL-15/Rα X Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]H0L0, 11B2D10[NKG2D]_H0L0, 16F31[NKG2D]_H1L1, mAb A[NKG2D]_H1L1, mAb A[NKG2D]H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, the corresponding SEQ ID NOS, and sequence identifiers described herein in the sequence listing and FIG. 117A-FIG. 117C with either an IL-15 N4D/N65D variant or an IL-15 D30N/N65D variant or an IL-15 D30N/E64Q/N65D variant.

In the scIL-15/Rα X Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, the corresponding SEQ ID NOS, and sequence identifiers described herein in the sequence listing and FIG. 117A-FIG. 117C with either an IL-15 N4D/N65D variant or an IL-15 D30N/N65D variant or an IL-15 D30N/E64Q/N65D variant, and with appropriate cysteine substitutions.

In the scIL-15/RαX Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, the corresponding SEQ ID NOS, and sequence identifiers described herein in the sequence listing and FIG. 117A-FIG. 117C, and the skew variant pair S364K/E357Q:L368D/K370S.

In the scIL-15/RαX Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, the corresponding SEQ ID NOS, and sequence identifiers described herein in the sequence listing and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the scIL-15/RαX Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, the corresponding SEQ ID NOS, and sequence identifiers described herein in the sequence listing and FIG. 117A-FIG. 117C, with a FIG. 57D format: e.g., the skew variants S364K/E357Q (on the anti-NKG2D monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

In the scIL-15/Rα X Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, the corresponding SEQ ID NOS, and sequence identifiers described herein in the sequence listing and FIG. 117A-FIG. 117C, with a FIG. 57D format: e.g., the skew variants S364K/E357Q (on the IL-15 complex monomer) and L368D/K370S (on the anti-NKG2D monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

In some embodiments, the NKG2D-targeted IL-15(N4D/N65D)/Rα-Fc fusion protein of the invention is selected from the group consisting of XENP27195, XENP27197, XENP27615, XENP27616, XENP27617, XENP27618, XENP27619, XENP27620, XENP27621, XENP27622, XENP27623, XENP27624, XENP27625, XENP27626, XENP27627, XENP27628, XENP27629, XENP27630, XENP27631, XENP27632, XENP27633, XENP27634, XENP27635, XENP27636, XENP27637, XENP27638, XENP30592, and XENP31077, as depicted in FIGS. 122A-122N and the corresponding SEQ ID NOS.

In some embodiments, the NKG2D-targeted IL-15(N4D/N65D)/Rα-Fc fusion protein of the invention is selected from the group consisting of XENP27195, XENP27615, XENP27616, XENP27617, XENP27618, XENP27619, XENP27620, XENP27621, XENP27622, XENP27623, XENP27624, XENP27625, XENP27626, XENP27627, XENP27628, XENP27629, XENP27630, XENP27631, XENP27632, XENP27633, XENP27634, XENP27635, XENP27636, XENP27637, XENP27638, and XENP30592. In some instances, the NKG2D-targeted IL-15/Rα-Fc fusion protein includes M428L/N434S substitutions in each of the Fc domain variants.

In some embodiments, the NKG2D-targeted IL-15 (D30N/N65D)/Rα-Fc fusion proteins of the invention are selected from the group consisting of XENP30453, XENP30593, XENP30595, XENP31078, and XENP31080, as depicted in FIGS. 138A-138C and the corresponding SEQ ID NOS. In various instances, the NKG2D-targeted IL-15(D30N/N65D)/Rα-Fc fusion proteins include M428L/N434S substitutions in each of the Fc domain variants.

In some embodiments, the NKG2D-targeted IL-15 (D30N/E64Q/N65D)/Rα-Fc fusion proteins of the invention are selected from the group consisting of XENP30594, XENP30596, XENP31079, XENP31081, XENP33332, XENP33334, XENP33336, XENP33338, XENP33340, XENP33342, XENP33344, XENP33346, XENP33350, XENP33352, XENP33354, XENP33356, XENP33358, XENP33360, XENP33362, and XENP33364, as provided in FIGS. 139A-139J and the representative SEQ ID NOS.

In various instances, the NKG2D-targeted IL-15(D30N/ E64Q/N65D)/Rα-Fc fusion proteins include M428L/N434S substitutions in each of the Fc domain variants. Exemplary embodiments of such proteins include XENP31079, XENP31081, XENP33332, XENP33334, XENP33336, XENP33338, XENP33340, XENP33342, XENP33344, XENP33346, as provided in FIGS. 139A-139J and the representative SEQ ID NOS In the scIL-15/Rαx Fab format, one preferred embodiment utilizes the anti-NKG2D ABD having the sequence depicted in FIG. 61A. In some embodiments, the IL-15 complex of the scIL-15/Rαx Fab utilizes the sequence depicted in FIG. 61A. In some cases, the heterodimeric protein is XENP24533. In some embodiments, the NKG2D-targeted IL-15/Rα-Fc fusion protein is a variant of XENP24533 such that the IL-15 variant of the protein has the amino acid substitution(s) D30N, N1D/D30N, N4D/ D30N, N4D/N65D, D30N/E64Q, D30N/N65D, or D30N/ E64Q/N65D.

In the scIL-15/Rαx Fab format, one preferred embodiment utilizes the anti-NKG2D ABD having the sequence depicted in FIG. 61A. In some embodiments, the IL-15 complex of the scIL-15/Rαx Fab utilizes the sequence depicted in FIG. 61A. In some cases, the heterodimeric protein is XENP24534. In some embodiments, the NKG2D-targeted IL-15/Rα-Fc fusion protein is a variant of XENP24534 such that the IL-15 variant of the protein has the amino acid substitution(s) D30N, N1D/D30N, N4D/ D30N, N4D/N65D, D30N/E64Q, D30N/N65D, or D30N/ E64Q/N65D.

In the scIL-15/Rαx Fab format, one preferred embodiment utilizes the anti-NKG2D ABD having the sequence depicted in FIG. 61B. In some embodiments, the IL-15 complex of the scIL-15/Rαx Fab utilizes the sequence depicted in FIG. 61B. In some cases, the heterodimeric protein is XENP24535. In some embodiments, the NKG2D-targeted IL-15/Rα-Fc fusion protein is a variant of XENP24535 such that the IL-15 variant of the protein has the amino acid substitution(s) D30N, N1D/D30N, N4D/ D30N, N4D/N65D, D30N/E64Q, D30N/N65D, or D30N/ E64Q/N65D.

In the scIL-15/Rαx Fab format, one preferred embodiment utilizes the skew variant pair S364K/E357Q:L368D/ K370S.

In the scIL-15/Rαx Fab format, one preferred embodiment utilizes the skew variants S364K/E357Q (on the anti-NKG2D monomer) and L368D/K370S (on the IL-15 complex monomer), the pI variants Q295E/N384D/Q418E/ N421D (on the IL-15 complex side), the ablation variants E233P/L234V/L235A/G236_/S267K on both monomers, and optionally the 428L/434S variants on both sides.

In some embodiments, the heterodimeric protein comprises: (a) a first monomer comprising, from N- to C-terminus: i) an IL-15 sushi domain; ii) a first domain linker; iii) a variant IL-15 domain; iv) a second domain linker; v) a first variant Fc domain comprising CH2-CH3; and (b) a second monomer comprising a heavy chain comprising VH-CH1-hinge-CH2-CH3, wherein the CH2-CH3 is a second variant Fc domain; and c) a light chain comprising VL-CL; wherein the VH and VL form an antigen binding domain that binds NKG2D.

In some instances, the anti-NKG2D ABD of the heterodimeric protein of the present invention has the sequences of MS [NKG2D]_H0L0 Fab-Fc heavy chain and MS [NKG2D]_H0L0 light chain, as shown in FIGS. 61A and 61B. In some embodiments, the invention provides a targeted heterodimeric Fc fusion protein comprising an ABD that binds to NKG2D and an IL-15/IL-15Rα fusion protein, and can be any format shown in FIG. 57A-FIG. 57F. In one embodiment, a bifunctional heterodimeric Fc fusion protein comprising two antigen binding domains that bind to NKG2D and an IL-15/IL-15Rα fusion protein, and can be any format shown in FIG. 57G-FIG. 57K.

E. Fab x ncIL-15/Rα

This embodiment is shown in FIG. 57E, and comprises four monomers. The first monomer comprises, from N- to C-terminus, the sushi domain-domain linker-CH2-CH3, and the second monomer comprises a heavy chain, VH-CH1-hinge-CH2-CH3. The third monomer is the IL-15 domain. The fourth monomer is a light chain, VL-CL This is generally referred to as "Fab X ncIL-15/Rα", with the "nc" standing for "non-covalent" referring to the self-assembling non-covalent attachment of the IL-15 and sushi domain. A preferred combination of variants for this embodiment are found in FIG. 92C.

Referring to FIG. 57E, the Fab x ncIL-15/Rα(or ncIL-15/Rαx Fab) format comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a non-covalent IL-15/Rαcomplex is formed. In the Fab x ncIL-15/Rαformat, one preferred embodiment utilizes the skew variant pair S364K/E357Q:L368D/K370S. In the Fab x ncIL-15/Rαformat, one preferred embodiment utilizes the skew variants S364K/E357Q (on the anti-NKG2D monomer) and L368D/K370S (on the IL-15 complex monomer), the pI variants Q295E/N384D/Q418E/N421D (on the IL-15 complex side), the ablation variants E233P/L234V/ L235A/G236_/S267K on both monomers, and optionally the 428L/434S variants on both sides.

In some embodiments, the heterodimeric protein comprises: a) a first monomer comprising a heavy chain comprising VH-CH1-hinge-CH2-CH3, wherein said CH2-CH3 is a first variant Fc domain; b) a second monomer comprising, from N- to C-terminus; i) an IL-15 sushi domain; ii) a first domain linker; iii) a second variant Fc domain comprising CH2-CH3; c) a third monomer comprising a variant IL-15 domain; and d) a fourth monomer comprising a light chain comprising VL-CL; wherein the VH and VL form an antigen binding domain that binds human NKG2D.

In the ncIL-15/RαX Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117.

In the ncIL-15/Rα X Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with either an IL-15 N4D/N65D variant or an IL-15 D30N/N65D variant or an IL-15 D30N/E64Q/N65D variant.

In the ncIL-15/Rα X Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant, and with appropriate cysteine substitutions.

In the ncIL-15/Rα X Fab format, one preferred embodiment utilizes the anti-NKG2D ABD having the variable heavy and light domain pair selected from 1D7B4_H1L1, 6E5A7_H0L0, 6H7E7_H0L0, mAb E_H1L1, 11B2D10_H0L0, 16F31_H1L1, mAb D_H1L1, KYK1.0_H1L1, KYK2.0_H0L0, mAb A_H1L1, mAb A_H1L2, mAb A_H2L1, mAb A_H2L2, mAb B_H1L1, mAb B_H1L1.1, mAb B_H1L2, mAb B_H2L1, mAb B_H2L1.1, mAb B_H2L2, mAb B_H3L1, mAb B_H3L1.1, mAb B_H3L2, mAb C_H1L1, mAb C_H1L2, mAb C_H2L1, and mAb C_H2L2, as shown in FIG. 117A-FIG. 117C, and the skew variant pair S364K/E357Q:L368D/K370S.

In the ncIL-15/Rα X Fab format, one preferred embodiment utilizes the anti-NKG2D ABD having the variable heavy and light domain pair selected MS[NKG2D]_H0L0, KYK-1.0[NKG2D]_H1L, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]_H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the ncIL-15/Rα X Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57E format: e.g., the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

F. Fab x dsIL-15/Rα

This embodiment is shown in FIG. 57F, and comprises four monomers. The first monomer comprises, from N- to C-terminus, the sushi domain-domain linker-CH2-CH3, wherein the sushi domain has been engineered to contain a cysteine residue, and the second monomer comprises a heavy chain, VH-CH1-hinge-CH2-CH3. The third monomer is the IL-15 domain, also engineered to have a cysteine residue, such that a disulfide bridge is formed under native cellular conditions. The fourth monomer is a light chain, VL-CL. This is generally referred to as "Fab X dsIL-15/

Rα", with the "ds" standing for "disulfide" referring to the self-assembling non-covalent attachment of the IL-15 and sushi domain.

Referring to FIG. 57F, the Fab x dsIL-15/Rα(or dsIL-15/Rαx Fab) format comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a covalent IL-15/Rα complex is formed as a result of engineered cysteines.

In the Fab x dsIL-15/Rα format, one preferred embodiment utilizes the skew variant pair S364K/E357Q:L368D/K370S. In the Fab x dsIL-15/Rα format, one preferred embodiment utilizes the skew variants S364K/E357Q (on the anti-NKG2D monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In some embodiments, the heterodimeric protein comprises: a) a first monomer comprising a heavy chain comprising VH-CH1-hinge-CH2-CH3, wherein said CH2-CH3 is a first variant Fc domain; b) a second monomer comprising, from N- to C-terminus: i) an IL-15 sushi domain with a cysteine residue; ii) a first domain linker; and iii) a second variant Fc domain comprising CH2-CH3; c) a third monomer comprising a variant IL-15 domain comprising a cysteine residue; and d) a fourth monomer comprising a light chain comprising VL-CL; and wherein the IL-15 sushi domain and the variant IL-15 domain form a disulfide bond, and the VH and VL form an antigen binding domain that binds human NKG2D.

In the dsIL-15/Rα X Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C.

In the dsIL-15/Rα X Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant.

In the dsIL-15/Rα X Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant, and with appropriate cysteine substitutions.

In the dsIL-15/RαX Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S.

In the dsIL-15/RαX Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the dsIL-15/RαX Fab format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57F format: e.g., the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

G. mAb-scIL-15/Rα

This embodiment is shown in FIG. 57G, and comprises three monomers (although the fusion protein is a tetramer). The first monomer comprises a heavy chain, VH-CH1-hinge-CH2-CH3. The second monomer comprises a heavy chain with a scIL-15 complex, VH-CH1-hinge-CH2-CH3-domain linker-sushi domain-domain linker-IL-15. The third (and fourth) monomer are light chains, VL-CL. This is generally referred to as "mAb-scIL-15/Rα", with the "sc" standing for "single chain".

Referring to FIG. 57G, the mAb-scIL-15/Rα format comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form Fabs with the VHs.

In the mAb-scIL-15/Rαformat, one preferred embodiment utilizes the skew variant pair S364K/E357Q:L368D/K370S. One preferred embodiment utilizes the skew variants S364K/E357Q (on one monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In some embodiments, the heterodimeric protein comprises: (a) a first monomer comprising a heavy chain comprising VH-CH1-hinge-CH2-CH3, wherein said CH2-CH3 is a first variant Fc domain; (b) a second monomer comprising VH-CH1-hinge-CH2-CH3-domain linker-IL-15 sushi domain-domain linker-IL-15 variant, wherein the CH2-CH3 is a second variant Fc domain; and (c) a third monomer comprising a light chain comprising VL-CL; wherein the VH and VL domains bind human NKG2D.

In the mAb-scIL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C.

In the mAb-scIL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIGS. 117A-117C with either an IL-15 N4D/N65D variant or an IL-15 D30N/N65D variant or an IL-15 D30N/E64Q/N65D variant.

In the mAb-scIL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant, and with appropriate cysteine substitutions.

In the mAb-scIL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S.

In the mAb-scIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the mAb-scIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57G format: e.g., the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

H. mAb-ncIL-15/Rα

This embodiment is shown in FIG. 57H, and comprises four monomers (although the heterodimeric fusion protein is a pentamer). The first monomer comprises a heavy chain, VH-CH1-hinge-CH2-CH3. The second monomer comprises a heavy chain with an IL-15Rα(sushi) domain, VH-CH1-hinge-CH2-CH3-domain linker-sushi domain. The third monomer is an IL-15 domain. The fourth (and fifth) monomer are light chains, VL-CL. This is generally referred to as "mAb-ncIL-15/Rα", with the "nc" standing for "non-covalent".

Referring to FIG. 57H, the mAb-ncIL-15/Rα format comprises VH fused to the N-terminus of a first and a second heterodimeric Fc, with IL-15Rα(sushi) fused to the C-terminus of one of the heterodimeric Fc-region, while corresponding light chains are transfected separately so as to form a Fabs with the VHs, and while IL-15 is transfected separately so that a non-covalent IL-15/Rα complex is formed. An illustrative embodiment of such a heterodimeric protein can be XENP24543.

In the mAb-ncIL-15/Rα format, one preferred embodiment utilizes the skew variant pair S364K/E357Q:L368D/K370S. One preferred embodiment utilizes the skew variants S364K/E357Q (on one monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In some embodiments, the heterodimeric protein comprises: (a) a first monomer comprising a heavy chain comprising VH-CH1-hinge-CH2-CH3, wherein the CH2-CH3 is a first variant Fc domain; (b) a second monomer comprising VH-CH1-hinge-CH2-CH3-domain linker-IL-15 sushi domain, wherein the CH2-CH3 is a second variant Fc domain; (c) a third monomer comprising a variant IL-15 domain; and (d) a fourth monomer comprising a light chain comprising VL-CL; wherein the VH and VL domains bind human NKG2D.

In the mAb-ncIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C.

In the mAb-ncIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant.

In the mAb-ncIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_

H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant, and with appropriate cysteine substitutions.

In the mAb-ncIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S.

In the mAb-ncIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the mAb-ncIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57H format: e.g., the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

I. mAb-dsIL-15/Rα

This embodiment is shown in FIG. 57I, and comprises four monomers (although the heterodimeric fusion protein is a pentamer). The first monomer comprises a heavy chain, VH-CH1-hinge-CH2-CH3. The second monomer comprises a heavy chain with an IL-15Rα(sushi) domain: VH-CH1-hinge-CH2-CH3-domain linker-sushi domain, where the sushi domain has been engineered to contain a cysteine residue. The third monomer is an IL-15 domain, which has been engineered to contain a cysteine residue, such that the IL-15 complex is formed under physiological conditions. The fourth (and fifth) monomer are light chains, VL-CL. This is generally referred to as "mAb-dsIL-15/Rα", with the "ds" standing for "disulfide".

Referring to FIG. 57I, the mAb-dsIL-15/Rα format comprises VH fused to the N-terminus of a first and a second heterodimeric Fc, with IL-15Rα(sushi) fused to the C-terminus of one of the heterodimeric Fc-region, while corresponding light chains are transfected separately so as to form Fabs with the VHs, and while and while IL-15 is transfected separately so that a covalently linked IL-15/Rα complex is formed as a result of engineered cysteines.

In the mAb-dsIL-15/Rα format, one preferred embodiment utilizes the skew variant pair S364K/E357Q:L368D/K370S. One preferred embodiment utilizes the skew variants S364K/E357Q (on one monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides.

In some embodiments, the heterodimeric protein comprises: (a) a first monomer comprising a heavy chain comprising VH-CH1-hinge-CH2-CH3, wherein the CH2-CH3 is a first variant Fc domain; (b) a second monomer comprising VH-CH1-hinge-CH2-CH3-domain linker-IL-15 sushi domain, wherein said variant IL-15 sushi domain comprises a cysteine residue and wherein the CH2-CH3 is a second variant Fc domain; (c) a third monomer comprising a variant IL-15 domain comprising a cysteine residue; and (d) a fourth monomer comprising a light chain comprising VL-CL; wherein the variant IL-15 sushi domain and the variant IL-15 domain form a disulfide bond and the VH and VL domains bind human NKG2D.

In the mAb-dsIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31

[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C.

In the mAb-dsIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant.

In the mAb-dsIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant, and with appropriate cysteine substitutions.

In the mAb-dsIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S.

In the mAb-dsIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the mAb-dsIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57I format: e.g., the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant J. Central-IL-15/Rα

This embodiment is shown in FIG. 57J, and comprises four monomers forming a tetramer. The first monomer comprises a VH-CH1-[optional domain linker]-IL-15-[optional domain linker]-CH2-CH3, with the second optional domain linker sometimes being the hinge domain. The second monomer comprises a VH-CH1-[optional domain linker]-sushi domain-[optional domain linker]-CH2-CH3, with the second optional domain linker sometimes being the hinge domain. The third (and fourth) monomers are light chains, VL-CL. This is generally referred to as "Central-IL-15/Rα".

Referring to FIG. 57J, the central-IL-15/Rα format comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs.

In the central-IL-15/Rα format, one preferred embodiment utilizes the skew variant pair S364K/E357Q:L368D/K370S. One preferred embodiment utilizes the skew variants S364K/E357Q (on one monomer) and L368D/K370S (on one monomer), the pI variants Q295E/N384D/Q418E/N421D (on one monomer), the ablation variants E233P/L234V/L235A/G236_/S267K on both monomers, and optionally the 428L/434S variants on both sides.

In some embodiments, the heterodimeric protein comprises: (a) a first monomer comprising, from N- to C-terminal, a VH-CH1-domain linker-variant IL-15 domain-domain linker-CH2-CH3, wherein said CH2-CH3 is a first variant Fc domain; (b) a second monomer comprising, from N- to C-terminal, a VH-CH1-domain linker-variant IL-15 sushi domain-domain linker-CH2-CH3, wherein said CH2-CH3 is a first variant Fc domain; and (c) a third monomer comprising a light chain comprising VL-CL; wherein the VH and the VL form an antigen binding domain that binds human NKG2D.

In the central-IL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C.

In the central-IL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant.

In the central-IL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant, and with appropriate cysteine substitutions.

In the central-IL-15/Rαformat, one preferred embodiment utilizes the anti-NKG2D ABD having the variable heavy and light domain pair selected from 1D7B4_H1L1, 6E5A7_H0L0, 6H7E7_H0L0, mAb E_H1L1, 11B2D10_H0L0, 16F31_H1L1, mAb D_H1L1, KYK1.0_H1L1, KYK2.0_H0L0, mAb A_H1L1, mAb A_H1L2, mAb A_H2L1, mAb A_H2L2, mAb B_H1L1, mAb B_H1L1.1, mAb B_H1L2, mAb B_H2L1, mAb B_H2L1.1, mAb B_H2L2, mAb B_H3L1, mAb B_H3L1.1, mAb B_H3L2, mAb C_H1L1, mAb C_H1L2, mAb C_H2L1, and mAb C_H2L2, as shown in FIG. 117A-FIG. 117C, and the skew variant pair S364K/E357Q:L368D/K370S.

In the central-IL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the central-IL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L, 6E5A7[NKG2D]_H0L0, 6H7E7[NKG2D]_ H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57J format: e.g., the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

K. Central-scIL-15/Rα

This embodiment is shown in FIG. 57K, and comprises four monomers forming a tetramer. The first monomer comprises a VH-CH1-[optional domain linker]-sushi domain-domain linker-IL-15-[optional domain linker]-CH2-CH3, with the second optional domain linker sometimes being the hinge domain. The second monomer comprises a VH-CH1-hinge-CH2-CH3. The third (and fourth) monomers are light chains, VL-CL. This is generally referred to as "Central-scIL-15/Rα", with the "sc" standing for "single chain".

Referring to FIG. 57K, the central-scIL-15/Rαformat comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form Fabs with the VHs.

In the central-scIL-15/Rαformat, one preferred embodiment utilizes the skew variant pair S364K/E357Q:L368D/K370S.

In some embodiments, the heterodimeric protein comprises: (a) a first monomer comprising from N- to C-terminus, VH-CH1-domain linker-IL-15 sushi domain-domain linker-variant IL-15 domain-domain linker-CH2-CH3, wherein said CH2-CH3 is a first variant Fc domain; (b) a second monomer comprising a heavy chain comprising VH-CHI-hinge-CH2-CH3, wherein the CH2-CH3 is a second variant Fc domain; and (c) a third monomer comprising a light chain comprising VL-CL; wherein the VH and the VL form an antigen binding domain that binds human NKG2D.

In the central-scIL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C.

In the central-scIL-15/Rαformat, one preferred embodiment utilizes the anti-NKG2D ABD having the variable heavy and light domain pair selected from 1D7B4_H1L1, 6E5A7_H0L0, 6H7E7_H0L0, mAb E_H1L1, 11B2D10_H0L0, 16F31_H1L1, mAb D_H1L1, KYK1.0_H1L1, KYK2.0_H0L0, mAb A_H1L1, mAb A_H1L1, mAb A_H2L1, mAb A_H2L2, mAb B_H1L1, mAb B_H1L1.1, mAb B_H1L2, mAb B_H2L1, mAb B_H2L1.1, mAb B_H2L2, mAb B_H3L1, mAb B_H3L1.1, mAb B_H3L2, mAb C_H1L1, mAb C_H1L2, mAb C_H2L1, and mAb C_H2L2, as shown in FIG. 117A-FIG. 117C with either an IL-15 N4D/N65D variant or an IL-15 D30N/N65D variant or an IL-15 D30N/E64Q/N65D variant.

In the central-scIL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C with either an IL-15 N4D/N65D variant or an IL-15 D30N/N65D variant or an IL-15 D30N/E64Q/N65D variant, and with appropriate cysteine substitutions.

In the central-scIL-15/Rαformat, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S.

In the central-scIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, and the skew variant pair S364K/E357Q:L368D/K370S with either an IL-15 N4D/N65D variant or an IL-15 D30N/N65D variant or an IL-15 D30N/E64Q/N65D variant.

In the central-scIL-15/Rα format, one preferred embodiment utilizes the anti-NKG2D ABD having the variable heavy and light domain pair selected from MS[NKG2D]_H0L0, KYK-1.0[NKG2D]_H1L1, KYK-2.0[NKG2D]_H0L0, 1D7B4[NKG2D]_H1L1, 6E5A7[NKG2D]_H0L0, 6H7E7[NKG2D]_H0L0, 11B2D10[NKG2D]_H0L0, 16F31[NKG2D]_H1L1, mAb A[NKG2D]_H1L1, mAb A[NKG2D]_H1L2, mAb A[NKG2D]_H2L1, mAb A[NKG2D]_H2L2, mAb B[NKG2D]_H1L1, mAb B[NKG2D]_H1L1.1, mAb B[NKG2D]_H1L2, mAb B[NKG2D]_H2L1, mAb B[NKG2D]_H2L1.1, mAb B[NKG2D]_H2L2, mAb B[NKG2D]_H3L1, mAb B[NKG2D]_H3L1.1, mAb B[NKG2D]_H3L2, mAb C[NKG2D]_H1L1, mAb C[NKG2D]_H1L2, mAb C[NKG2D]_H2L1, mAb C[NKG2D]H2L2, mAb D[NKG2D]_H1L1, mAb E[NKG2D]_H1L1, as shown in the corresponding SEQ ID NOS, sequence identifiers, the sequence listing, and FIG. 117A-FIG. 117C, with a FIG. 57K format: e.g., the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/L234V/L235A/G236_/S267K on both monomers, and optionally the 428L/434S variants on both sides. In such embodiments, the format includes an IL-15 N4D/N65D variant or an IL-15 D30N/N65D variant or an IL-15 D30N/E64Q/N65D variant.

In some embodiments, the invention provides a heterodimeric Fc fusion protein comprising one or more ABDs that bind NKG2D and an IL-15/IL-15Rα fusion protein, and can be any format shown in FIG. 57A-FIG. 57F. In one embodiment, a heterodimeric Fc fusion protein comprising two antigen binding domains that bind to NKG2D and an IL-15/IL-15Rα fusion protein, and can be any format shown in FIG. 57G-FIG. 57K.

Nucleic acids, expression vectors and host cells are all provided as well, in addition to methods of making these proteins and treating patients with them.

VII. Particularly Useful Embodiments of the Invention

The present invention provides a NKG2D-targeted IL-15/IL-15Rαheterodimeric protein comprising at least two monomers, one of which contains an anti-NKG2D ABD and the other that contains an IL-15/Rα complex, joined using heterodimeric Fc domains.

In some embodiments, the first and the second Fc domains have a set of amino acid substitutions selected from the group consisting of S267K/L368D/K370S:S267K/S364K/E357Q; S364K/E357Q:L368D/K370S; L368D/K370S:S364K; L368E/K370S:S364K; T411E/K360E/Q362E:D401K; L368D/K370S:S364K/E357L and K370S:S364K/E357Q, according to EU numbering.

In some instances, the first and/or the second Fc domains have an additional set of amino acid substitutions comprising Q295E/N384D/Q418E/N421D, according to EU numbering. In some cases, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In some embodiments, the first and the second Fc domains have an amino acid substitution comprising M428L/N434S.

In some embodiments, the IL-15 protein has a polypeptide sequence selected from the group consisting of SEQ ID NO: 1 (full-length human IL-15) and SEQ ID NO:2 (truncated human IL-15 or human IL-15 mature form), and the IL-15Rα protein has a polypeptide sequence selected from the group consisting of SEQ ID NO:3 (full-length human IL-15Rα) and SEQ ID NO:4 (sushi domain of human IL-15Rα).

In some embodiments, the IL-15 protein and the IL-15Rα protein can have a set of amino acid substitutions selected from the group consisting of E87C:D96/P97/C98; E87C:D96/C97/A98; V49C:S40C; L52C:S40C; E89C:K34C; Q48C:G38C; E53C:L42C; C42S:A37C; and L45C:A37C, respectively.

In some embodiments, the IL-15 protein is an IL-15 protein variant comprising one or more amino acid substitutions selected from N1D, N4D, D8N, D30N, D61N, E64Q, N65D, or Q108E substitution. In some embodiments, the IL-15 protein variant comprises an amino acid substitution(s) selected from D30N, N1D/D30N, N1D/D61N, N1D/E64Q, N4D/D30N, N4D/D61N, N4D/E64Q, N4D/N65D, D8N/D61N, D8N/E64Q, D30N/E64Q, D30N/N65D, D61N/E64Q, D61N/N65D, D61N/Q108E, E64Q/Q108E, N65D/Q108E, N1D/N4D/D8N, D30N/E64Q/N65D, D61N/E64Q/N65D, D61N/N65D/Q108E, N1D/D61N/E64Q, N1D/D61N/E64Q/Q108E, or N4D/D61N/E64Q/Q108E. In particular embodiments, the IL-15 protein variant comprises an amino acid substitution(s) selected from N4D/N65D, D30N/N65D, or D30N/E64Q/N65D.

In one aspect, the heterodimeric protein described herein comprises (a) an IL-15/IL-15Rα fusion protein comprising an IL-15Rα protein, an IL-15 protein, and a first Fc domain, wherein the IL-15Rα protein is covalently attached to the N-terminus of the IL-15 protein using a first domain linker and the IL-15 protein is covalently attached to the N-terminus of the first Fc domain using a second domain linker, or wherein the IL-15 protein is covalently attached to the N-terminus of the IL-15Rα protein using a first domain linker and the IL-15Rα protein is covalently attached to the N-terminus of the first Fc domain using a second domain linker; and (b) an antigen binding domain monomer comprising a heavy chain comprising a VH-CH1-hinge-CH2-CH3 monomer, wherein $V_H$ is a variable heavy chain and CH2-CH3 is a second Fc domain, and a light chain comprising a variable light chain and a light constant domain (e.g., VL-CL); wherein the first and the second Fc domains have a set of amino acid substitutions selected from the group consisting of S267K/L368D/K370S:S267K/S364K/E357Q; S364K/E357Q:L368D/K370S; L368D/K370S:S364K; L368E/K370S:S364K; T411E/K360E/Q362E:D401K; L368D/K370S:S364K/E357L and K370S:S364K/E357Q, according to EU numbering. In some embodiments, the first and/or second Fc domains have an additional set of amino acid substitutions comprising Q295E/N384D/Q418E/N421D, according to EU numbering. In particular embodiments, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering. In some instances, the IL-15 protein of the invention is any one of the IL-15 protein variants described herein. In some embodiments, the IL-15 protein variant has an amino acid sequence set forth in the Figures herein.

In some cases, the antigen binding domain monomer may bind NKG2D. In some embodiments, the NKG2D antigen binding domain monomer is an anti-NKG2D scFv or an anti-NKG2D Fab. In some embodiments, the antigen binding domain monomer is an anti-NKG2D Fab. The heterodimeric protein may be referred to herein as a "scIL-15/Rα (sushi) x anti-NKG2D Fab".

In some embodiments, the NKG2D-targeted IL-15/IL-15Rα-Fc heterodimeric fusion protein of the invention is XENP27195, XENP27197, XENP27615, XENP27616, XENP27617, XENP27618, XENP27619, XENP27620, XENP27621, XENP27622, XENP27623, XENP27624, XENP27625, XENP27626, XENP27627, XENP27628, XENP27629, XENP27630, XENP27631, XENP27632, XENP27633, XENP27634, XENP27635, XENP27636, XENP27637, XENP27638, XENP30592, or XENP31077, which includes an IL-15(N4D/N65D) variant.

In some embodiments, the NKG2D-targeted IL-15/IL-15Rα-Fc heterodimeric fusion protein of the invention comprises an IL-15(N4D/N65D) variant. XENP27195, as depicted in FIG. 122A, includes an IL-15(N4D/N65D) variant and an anti-NKG2D ABD having the variable heavy chain and light chain pair of KYK2.0_H0L0 (as shown in FIG. 117A). XENP27197, as depicted in FIG. 122A, includes an IL-15(N4D/N65D) variant and an anti-NKG2D ABD having the variable heavy chain and light chain pair of 1D7B4_H1L1 (as shown in FIG. 117A) and Xtend Fc variants. XENP27615, as depicted in FIG. 122B, includes an IL-15(N4D/N65D) variant and an anti-NKG2D ABD having the the variable heavy chain and light chain pair of 11B2D10_H0L0 (as shown in FIG. 117A). XENP27616, as depicted in FIG. 122B, includes an IL-15(N4D/N65D) variant and an anti-NKG2D ABD having the variable heavy chain and light chain pair of 6E5A7_H0L0 (as shown in FIG. 117A). XENP27617, as depicted in FIG. 122C, includes an IL-15(N4D/N65D) variant and an anti-NKG2D ABD having the variable heavy chain and light chain pair of 6H7E7_H0L0 (as shown in FIG. 117A). XENP27618, as depicted in FIG. 122C, includes an IL-15(N4D/N65D) variant and an anti-NKG2D ABD having the variable heavy chain and light chain pair of mAb E_H1L1 (as shown in FIG. 117A). XENP27619, as depicted in FIG. 122D, includes an IL-15(N4D/N65D) variant and an anti-NKG2D ABD having the variable heavy chain and light chain pair of 16F31_H1L1 (as shown in FIG. 117A) and Xtend Fc variants. XENP27620, as depicted in FIG. 122D, includes an IL-15(N4D/N65D) variant and an anti-NKG2D ABD having the variable heavy chain and light chain pair of mAb D_H1L1 (as shown in FIG. 117B). XENP27621, as depicted in FIG. 122E, includes an IL-15(N4D/N65D) variant and an anti-NKG2D ABD having the variable heavy chain and light chain pair of KYK1.0_H1L1 (as shown in FIG. 117A). XENP27622, as depicted in FIG. 122E, includes an IL-15 (N4D/N65D) variant and an anti-NKG2D ABD having the variable heavy chain and light chain pair of mAb B_H1L1 (as shown in FIG. 117B). XENP27623, as depicted in FIG. 122F, includes an IL-15(N4D/N65D) variant and an anti-NKG2D ABD having the variable heavy chain and light chain pair of mAb B_H1L1.1 (as shown in FIG. 117B). XENP27624, as depicted in FIG. 122F, includes an IL-15 (N4D/N65D) variant and an anti-NKG2D ABD having the variable heavy chain and light chain pair of mAb B_H1L2 (as shown in FIG. 117B). XENP27625, as depicted in FIG. 122G, includes an IL-15(N4D/N65D) variant and an anti-NKG2D ABD having the variable heavy chain and light chain pair of mAb B_H2L1 (as shown in FIG. 117B). XENP27626, as depicted in FIG. 122G, includes an IL-15 (N4D/N65D) variant and an anti-NKG2D ABD having the variable heavy chain and light chain pair of mAb B_H2L1.1 (as shown in FIG. 117B). XENP27627, as depicted in FIG. 122H, includes an IL-15(N4D/N65D) variant and an anti-NKG2D ABD having the variable heavy chain and light chain pair of mAb B_H2L2 (as shown in FIG. 117B). XENP27628, as depicted in FIG. 122H, includes an IL-15 (N4D/N65D) variant and an anti-NKG2D ABD having the variable heavy chain and light chain pair of mAb B_H3L1 (as shown in FIG. 117B). XENP27629, as depicted in FIG. 122I, includes an IL-15(N4D/N65D) variant and an anti-NKG2D ABD having the variable heavy chain and light chain pair of mAb B_H3L1.1 (as shown in FIG. 117B). XENP27630, as depicted in FIG. 122I, includes an IL-15 (N4D/N65D) variant and an anti-NKG2D ABD having the variable heavy chain and light chain pair of mAb B_H3L2 (as shown in FIG. 117B). XENP27631, as depicted in FIG. 122J, includes an IL-15(N4D/N65D) variant and an anti-NKG2D ABD having the variable heavy chain and light chain pair of mAb C_H1L1 (as shown in FIG. 117C). XENP27632, as depicted in FIG. 122J, includes an IL-15 (N4D/N65D) variant and an anti-NKG2D ABD having the variable heavy chain and light chain pair of mAb C_H1L2 (as shown in FIG. 117C). XENP27633, as depicted in FIG. 122K FIG. 122, includes an IL-15(N4D/N65D) variant and an anti-NKG2D ABD having the variable heavy chain and light chain pair of mAb C_H2L1 (as shown in FIG. 117C). XENP27634, as depicted in FIG. 122K, includes an IL-15 (N4D/N65D) variant and an anti-NKG2D ABD having the variable heavy chain and light chain pair of mAb C_H2L2 (as shown in FIG. 117C). XENP27635, as depicted in FIG. 122L, includes an IL-15(N4D/N65D) variant and an anti-NKG2D ABD having the variable heavy chain and light chain pair of mAb A_H1L1 (as shown in FIG. 117B). XENP27636, as depicted in FIG. 122L, includes an IL-15 (N4D/N65D) variant and an anti-NKG2D ABD having the variable heavy chain and light chain pair of mAb A_H1L2 (as shown in FIG. 117B). XENP27637, as depicted in FIG. 122M, includes an IL-15(N4D/N65D) variant and an anti-NKG2D ABD having the variable heavy chain and light chain pair of mAb A_H2L1 (as shown in FIG. 117B). XENP27638, as depicted in FIG. 122M, includes an IL-15 (N4D/N65D) variant and an anti-NKG2D ABD having the variable heavy chain and light chain pair of mAb A_H2L2 (as shown in FIG. 117B). XENP30592, as depicted in FIG. 122N, includes an IL-15(N4D/N65D) variant and an anti-NKG2D ABD having the variable heavy chain and light chain pair of 1D7B4_H1L1 (as shown in FIG. 117B). XENP31077, as depicted in FIG. 122N, includes an IL-15 (N4D/N65D) variant and an anti-NKG2D ABD having the variable heavy chain and light chain pair of mAb A_H1L1 (as shown in FIG. 117B) and Xtend Fc variants.

In some embodiments, the NKG2D-targeted IL-15/IL-15Rα-Fc heterodimeric fusion protein of the invention is XENP30453, XENP30593, XENP30595, XENP31078, or XENP31080, which includes an IL-15(D30N/N65D) variant.

In some embodiments, the NKG2D-targeted IL-15/IL-15Rα-Fc heterodimeric fusion protein of the invention comprises an IL-15(D30N/N65D) variant. XENP30453, as depicted in FIG. 138A, includes an IL-15(D30N/N65D) variant and an anti-NKG2D ABD having the variable heavy chain and light chain pair of MS_H0L0, as described herein. XENP30593, as depicted in FIG. 138A, includes an IL-15 (D30N/N65D) variant and an anti-NKG2D ABD having the variable heavy chain and light chain pair of 1D7B4_H1L1 (as shown in FIG. 117B). XENP30595, as depicted in FIG. 138B, includes an IL-15(D30N/N65D) variant and an anti-NKG2D ABD having the variable heavy chain and light chain pair of mAb_A_H1L1 (as shown in FIG. 117B). XENP31078, as depicted in FIG. 138B-FIG. 138C, includes an IL-15(D30N/N65D) variant and an anti-NKG2D ABD having the variable heavy chain and light chain pair of mAb_A_H1L1 (as shown in FIG. 117B) and Xtend Fc variants. XENP31080, as depicted in FIG. 138C, includes an IL-15(D30N/N65D) variant and an anti-NKG2D ABD having the variable heavy chain and light chain pair of 1D7B4_H1L1 (as shown in FIG. 117B) and Xtend Fc variants.

In some embodiments, the NKG2D-targeted IL-15/IL-15Rα-Fc heterodimeric fusion protein of the invention is of XENP30594, XENP30596, XENP31079, XENP31081, XENP33332, XENP33334, XENP33336, XENP33338, XENP33340, XENP33342, XENP33344, XENP33346, XENP33350, XENP33352, XENP33354, XENP33356, XENP33358, XENP33360, XENP33362, and XENP33364, which includes an IL-15(D30N/E64Q/N65D) variant.

In some embodiments, the NKG2D-targeted IL-15/IL-15Rα-Fc heterodimeric fusion protein of the invention comprises an IL-15(D30N/E64Q/N65D) variant. XENP30594, as depicted in FIG. 139A, includes an IL-15(D30N/E64Q/N65D) variant and an anti-NKG2D ABD having the variable heavy chain and light chain pair of 1D7B4_H1L1 (as shown in FIG. 117B). XENP30596, as depicted in FIG. 139A, includes an IL-15(D30N/E64Q/N65D) variant and an anti-NKG2D ABD having the variable heavy chain and light chain pair of mAb_A_H1L1 (as shown in FIG. 117B). XENP31079, as depicted in FIG. 139B, includes an IL-15(D30N/E64Q/N65D) variant and an anti-NKG2D ABD having the variable heavy chain and light chain pair of mAb_A_H1L1 (as shown in FIG. 117B) and Xtend Fc variants. XENP31081, as depicted in FIG. 139B-FIG. 139C, includes an IL-15(D30N/E64Q/N65D) variant and an anti-NKG2D ABD having the variable heavy chain and light chain pair of 1D7B4_H1L1 (as shown in FIG. 117) and Xtend Fc variants. XENP33332, as depicted in FIG. 139C, includes an IL-15(D30N/E64Q/N65D) variant and an anti-NKG2D ABD having the variable heavy chain and light chain pair of MS[NKG2D]_H0L0 and Xtend Fc variants. XENP33334, as depicted in FIG. 139C, includes an IL-15(D30N/E64Q/N65D) variant and an anti-NKG2D ABD having the variable heavy chain and light chain pair of mAb C[NKG2D]_H2L1 (as shown in FIG. 117C) and Xtend Fc variants. XENP33336, as depicted in FIG. 139D, includes an IL-15(D30N/E64Q/N65D) variant and an anti-NKG2D ABD having the variable heavy chain and light chain pair of mAb E[NKG2D]_H1L1 (as shown in FIG. 117A) and Xtend Fc variants. XENP33338, as depicted in FIG. 139D, includes an IL-15(D30N/E64Q/N65D) variant and an anti-NKG2D ABD having the variable heavy chain and light chain pair of 16F31[NKG2D]_H1L1 (as shown in FIG. 117A) and Xtend Fc variants. XENP33340, as depicted in FIG. 139E, includes an IL-15(D30N/E64Q/N65D) variant and an anti-NKG2D ABD having the variable heavy chain and light chain pair of KYK-1.0[NKG2D]_H1L1 (as shown in FIG. 117A) and Xtend Fc variants. XENP33342, as depicted in FIG. 139E, includes an IL-15(D30N/E64Q/N65D) variant and an anti-NKG2D ABD having the variable heavy chain and light chain pair of KYK-2.0[NKG2D]_H0L0 (as shown in FIG. 117A) and Xtend Fc variants. XENP33344, as depicted in FIG. 139F, includes an IL-15(D30N/E64Q/N65D) variant and an anti-NKG2D ABD having the variable heavy chain and light chain pair of mAb B[NKG2D]_H1L1 (as shown in FIG. 117B) and Xtend Fc variants. XENP33346, as depicted in FIG. 139F, includes an IL-15(D30N/E64Q/N65D) variant and an anti-NKG2D ABD having the variable heavy chain and light chain pair of mAb D[NKG2D]_H1L1 (as shown in FIG. 117B) and Xtend Fc variants. XENP33350, as depicted in FIG. 139G, includes an IL-15(D30N/E64Q/N65D) variant and an anti-NKG2D ABD having the variable heavy chain and light chain pair of MS[NKG2D]_H0L0. XENP33352, as depicted in FIG. 139G, includes an IL-15(D30N/E64Q/N65D) variant and an anti-NKG2D ABD having the variable heavy chain and light chain pair of mAb C[NKG2D]_H2L1 (as shown in FIG. 117C). XENP33352, as depicted in FIG. 139H, includes an IL-15(D30N/E64Q/N65D) variant and an anti-NKG2D ABD having the variable heavy chain and light chain pair of mAb E[NKG2D]_H1L1 (as shown in FIG. 117A). XENP33356, as depicted in FIG. 139H, includes an IL-15(D30N/E64Q/N65D) variant and an anti-NKG2D ABD having the variable heavy chain and light chain pair of 16F31[NKG2D]_H1L1 (as shown in FIG. 117A). XENP33358, as depicted in FIG. 139I, includes an IL-15(D30N/E64Q/N65D) variant and an anti-NKG2D ABD having the variable heavy chain and light chain pair of KYK-1.0[NKG2D]_H1L1 (as shown in FIG. 117A). XENP33360, as depicted in FIG. 139I, includes an IL-15(D30N/E64Q/N65D) variant and an anti-NKG2D ABD having the variable heavy chain and light chain pair of KYK-2.0[NKG2D]_H0L0 (as shown in FIG. 117A). XENP33362, as depicted in FIG. 139J, includes an IL-15(D30N/E64Q/N65D) variant and an anti-NKG2D ABD having the variable heavy chain and light chain pair of mAb B[NKG2D]_H1L1 (as shown in FIG. 117B). XENP33364, as depicted in FIG. 139J, includes an IL-15(D30N/E64Q/N65D) variant and an anti-NKG2D ABD having the variable heavy chain and light chain pair of mAb D[NKG2D]_H1L1 (as shown in FIG. 117B).

Also provided herein is a nucleic acid composition comprising one or more nucleic acids encoding any one of the NKG2D targeted IL-15/Rα-Fc fusion heterodimeric proteins described herein. In another aspect, the invention provides an expression vector composition comprising one or more expression vectors, each vector comprising a nucleic acid such that the one or more expression vectors encode any one of the heterodimeric proteins described herein. In other aspects, host cell comprising any one of the nucleic acid compositions or expression vector compositions is provided. In another aspect, the invention provides a method of producing any one of the heterodimeric protein described herein. The method comprises (a) culturing such a host cell under suitable conditions wherein the heterodimeric protein is expressed, and (b) recovering the heterodimeric protein. In yet another aspect, the invention provides a method of treating cancer in a patient, e.g, a human patient comprising administering a therapeutically effective amount of any one of the heterodimeric protein disclosed herein to the patient. In some instances, provided herein is a method of treating cancer in a patient in need thereof.

In some embodiments, the NKG2D-targeted IL-15/Rα-Fc fusions promote expansion of CD8$^+$ T cells, including CD8 effector T cells. In some embodiments, the NKG2D-targeted IL-15/Rα-Fc fusions facilitate expansion of NK cells. In some embodiments, the NKG2D-targeted IL-15/Rα-Fc fusions mediate expansion of CD8 effector T cells and NK cells. In some instances, any one of the NKG2D-targeted IL-15/Rα-Fc fusions described herein induces proliferation of CD8$^+$ T cells.

In some embodiments, the NKG2D-targeted IL-15/Rα-Fc fusions promote expansion of CD4$^+$ T cells. In some cases, such NKG2D-targeted IL-15/Rα-Fc fusions can promote expansion of CD4$^+$ T cells to a lesser degree than CD8$^+$ T cells. In other word, an exemplary NKG2D-targeted IL-15/Rα-Fc fusion protein is less potent in inducing proliferation of CD4+ T cells compared to CD8+ T cells and/or NK cells. In some embodiments, the NKG2D-targeted IL-15/Rα-Fc fusions robustly and selectively expand CD8+ T cells and NK cells over CD4+ T cells. In some cases, adminstratin of an NKG2D-targeted IL-15/Rα-Fc fusion protein outlined herein induces a CD8/CD4 T cell ratio in a subject that is useful for treating tumors.

In some embodiments, the NKG2D-targeted IL-15/Rα-Fc fusions outlined herein can be administered in combination with a checkpoint blockade therapy. In some embodiments, the combination therapy comprising a NKG2D-targeted IL-15/Rα-Fc fusion protein and a checkpoint blockade therapy enhances expansion of lymphocyte populations including but not limited to CD45+ lymphocytes, CD3+ T cells, CD8+ T cells, and NK cells. In some embodiments, the combination therapy increased expansion of lymphocyte populations, compared to single therapy. In some embodiments, the combination therapy increased expansion of CD4+ T cell, compared to single therapy. In some embodiments, the NKG2D-targeted IL-15/IL-15Rα Fc fusion protein and the checkpoint blockade antibody are administered concomitantly or sequentially.

In some embodiments, an NKG2D-targeted IL-15(N4D/N65D) variant/IL-15Rα-Fc heterodimeric fusion protein selected from the group consisting of XENP27195, XENP27197, XENP27615, XENP27616, XENP27617, XENP27618, XENP27619, XENP27620, XENP27621, XENP27622, XENP27623, XENP27624, XENP27625, XENP27626, XENP27627, XENP27628, XENP27629, XENP27630, XENP27631, XENP27632, XENP27633, XENP27634, XENP27635, XENP27636, XENP27637, XENP27638, XENP30592, and XENP31077 is administered to a subject in combination with a checkpoint blockade therapy comprising one selected from the group consisting of an anti-PD-1 antibody, an anti-TIM3 antibody, an anti-CTLA4 antibody, an anti-PD-L1 antibody, an anti-TIGIT antibody, and an anti-LAG3 antibody. In some embodiments, the anti-PD-1 antibody is nivolumab, pembrolizumab, or pidilizumab. In certain embodiments, an NKG2D-targeted IL-15(N4D/N65D) variant/IL-15Rα-Fc heterodimeric fusion protein selected from the group consisting of XENP27195, XENP27197, XENP27615, XENP27616, XENP27617, XENP27618, XENP27619, XENP27620, XENP27621, XENP27622, XENP27623, XENP27624, XENP27625, XENP27626, XENP27627, XENP27628, XENP27629, XENP27630, XENP27631, XENP27632, XENP27633, XENP27634, XENP27635, XENP27636, XENP27637, XENP27638, XENP30592, and XENP31077 is administered to a subject in combination with an anti-PD-1 antibody such as but not limited to nivolumab, pembrolizumab, and pidilizumab.

In some embodiments, an NKG2D-targeted IL-15(D30N/N65D) variant/IL-15Rα-Fc heterodimeric fusion protein selected from the group consisting of XENP30453, XENP30593, XENP30595, XENP31078, and XENP31080 is administered to a subject in combination with a checkpoint blockade therapy comprising one selected from the group consisting of an anti-PD-1 antibody, an anti-TIM3 antibody, an anti-CTLA4 antibody, an anti-PD-L1 antibody, an anti-TIGIT antibody, and an anti-LAG3 antibody. In some embodiments, the anti-PD-1 antibody is nivolumab, pembrolizumab, or pidilizumab.

In certain embodiments, an NKG2D-targeted IL-15 (D30N/N65D) variant/IL-15Rα-Fc heterodimeric fusion protein selected from the group consisting of XENP30453, XENP30593, XENP30595, XENP31078, and XENP31080 is administered to a subject in combination with an anti-PD-1 antibody such as but not limited to nivolumab, pembrolizumab, and pidilizumab.

In some embodiments, an NKG2D-targeted IL-15 (D30N/E64Q/N65D) variant/IL-15Rα-Fc heterodimeric fusion protein selected from the group consisting of XENP30594, XENP30596, XENP31079, XENP31081, XENP33332, XENP33334, XENP33336, XENP33338, XENP33340, XENP33342, XENP33344, XENP33346, XENP33350, XENP33352, XENP33354, XENP33356, XENP33358, XENP33360, XENP33362, and XENP33364 is administered to a subject in combination with a checkpoint blockade therapy comprising one selected from the group consisting of an anti-PD-1 antibody, an anti-TIM3 antibody, an anti-CTLA4 antibody, an anti-PD-L1 antibody, an anti-TIGIT antibody, and an anti-LAG3 antibody. In some embodiments, the anti-PD-1 antibody is nivolumab, pembrolizumab, or pidilizumab. In certain embodiments, an NKG2D-targeted IL-15 (D30N/E64Q/N65D) variant/IL-15Rα-Fc heterodimeric fusion protein selected from the group consisting of XENP30594, XENP30596, XENP31079, XENP31081, XENP33332, XENP33334, XENP33336, XENP33338, XENP33340, XENP33342, XENP33344, XENP33346, XENP33350, XENP33352, XENP33354, XENP33356, XENP33358, XENP33360, XENP33362, and XENP33364 is administered to a subject in combination with an anti-PD-1 antibody such as but not limited to nivolumab, pembrolizumab, and pidilizumab.

VIII. Additional Embodiments of the Invention

In one aspect, the present invention provides a targeted IL-15/IL-15Rαheterodimeric protein comprising: (a) a first monomer comprising, from N- to C-terminal: i) an IL-15 sushi domain; ii) a first domain linker; iii) a variant IL-15 domain; iv) a second domain linker; v) a first variant Fc domain comprising CH2-CH3; and (b) a second monomer comprising, from N- to C-terminal: i) a scFv domain; ii) a third domain linker; iii) a second variant Fc domain comprising CH2-CH3; wherein the scFv domain comprises a first variable heavy domain, an scFv linker and a first variable light domain, wherein the scFv domain binds human NKG2D.

In other aspects of the present invention, provided herein is a targeted IL-15/IL-15Rα heterodimeric protein comprising: (a) a first monomer comprising, from N- to C-terminal: i) an IL-15 sushi domain; ii) a first domain linker; iii) a first variant Fc domain comprising CH2-CH3; (b) a second monomer comprising, from N- to C-terminal: i) a scFv domain; ii) a third domain linker; iii) a second variant Fc domain comprising CH2-CH3; wherein the scFv domain comprises a first variable heavy domain, an scFv linker and a first variable light domain; and (c) a third monomer comprising a variant IL-15 domain; wherein the scFv domain binds human NKG2D. In some preferred embodiments, such targeted IL-15/IL-15Rα heterodimeric proteins bind human NKG2D.

In other aspects of the present invention, provided herein is a targeted IL-15/IL-15Rα heterodimeric protein comprising: (a) a first monomer comprising, from N- to C-terminal: i) a variant IL-15 sushi domain with a cysteine residue; ii) a first domain linker; iii) a first variant Fc domain comprising CH2-CH3; (b) a second monomer comprising, from N- to C-terminal: i) a scFv domain; ii) a third domain linker; iii) a second variant Fc domain comprising CH2-CH3; wherein the scFv domain comprises a first variable heavy domain, an scFv linker and a first variable light domain; and (c) a third monomer comprising a variant IL-15 domain comprising a cysteine residue; wherein the variant IL-15 sushi domain and the variant IL-15 domain form a disulfide bond and the scFv domain binds human NKG2D. In some preferred embodiments, such targeted IL-15/IL-15Rα heterodimeric proteins bind human NKG2D.

In some aspects of the present invention, provided herein is a targeted IL-15/IL-15Rα heterodimeric protein comprising: (a) a first monomer comprising, from N- to C-terminal: i) an IL-15 sushi domain; ii) a first domain linker; iii) a variant IL-15 domain; iv) a second domain linker; v) a first variant Fc domain comprising CH2-CH3; (b) a second monomer comprising a heavy chain comprising VH1-CH1-hinge-CH2-CH3, wherein the CH2-CH3 is a second variant Fc domain; and (c) a light chain comprising VL-CL; wherein the VH1 and VL form an antigen binding domain that binds human NKG2D. In some preferred embodiments, such targeted IL-15/IL-15Rα heterodimeric proteins bind human NKG2D.

In some aspects of the present invention, provided herein is a targeted IL-15/IL-15Rα heterodimeric protein comprising: (a) a first monomer comprising a heavy chain comprising VH1-CH1-hinge-CH2-CH3, wherein the CH2-CH3 is a first variant Fc domain; (b) a second monomer comprising, from N- to C-terminal: i) an IL-15 sushi domain; ii) a first domain linker; iii) a first variant Fc domain comprising CH2-CH3; (c) a third monomer comprising a variant IL-15 domain; and (d) a fourth monomer comprising a light chain comprising VL-CL; wherein the VH1 and VL form an antigen binding domain that binds human NKG2D. In some preferred embodiments, such targeted IL-15/IL-15Rα heterodimeric proteins bind human NKG2D.

In other aspects of the present invention, provided herein is a targeted IL-15/IL-15Rα heterodimeric protein comprising: (a) a first monomer comprising a heavy chain comprising VH1-CH1-hinge-CH2-CH3, wherein the CH2-CH3 is a first variant Fc domain; (b) a second monomer comprising, from N- to C-terminal: i) a variant IL-15 sushi domain with a cysteine residue; ii) a first domain linker; iii) a first variant Fc domain comprising CH2-CH3; (c) a third monomer comprising a variant IL-15 domain comprising a cysteine residue; and (d) a fourth monomer comprising a light chain comprising VL-CL; wherein the variant IL-15 sushi domain and the variant IL-15 domain form a disulfide bond and the scFv domain binds human NKG2D. In some preferred embodiments, such targeted IL-15/IL-15Rα heterodimeric proteins bind human NKG2D.

In some aspects of the present invention, provided herein is a targeted IL-15/IL-15Rα heterodimeric protein comprising: (a) a first monomer comprising a heavy chain comprising VH1-CH1-hinge-CH2-CH3, wherein the CH2-CH3 is a first variant Fc domain; (b) a second monomer comprising VH1-CH1-hinge-CH2-CH3-domain linker-IL-15 sushi domain-domain linker-IL-15 variant, wherein the CH2-CH3 is a second variant Fc domain; (c) a third monomer comprising a light chain comprising VL-CL; wherein the VH and VL domains bind human NKG2D. In some preferred embodiments, such targeted IL-15/IL-15Rα heterodimeric proteins bind human NKG2D.

In some aspects of the present invention, provided herein is a targeted IL-15/IL-15Rα heterodimeric protein comprising: (a) a first monomer comprising a heavy chain comprising VH1-CH1-hinge-CH2-CH3, wherein the CH2-CH3 is a first variant Fc domain; (b) a second monomer comprising VH1-CH1-hinge-CH2-CH3-domain linker-IL-15 sushi domain, wherein the CH2-CH3 is a second variant Fc domain; (c) a third monomer comprising a variant IL-15 domain; and (d) a fourth monomer comprising a light chain comprising VL-CL; wherein the VH and VL domains bind human NKG2D. In some preferred embodiments, such targeted IL-15/IL-15Rα heterodimeric proteins bind human NKG2D.

In some aspects of the present invention, provided herein is a targeted IL-15/IL-15Rα heterodimeric protein comprising: (a) a first monomer comprising a heavy chain comprising VH1-CH1-hinge-CH2-CH3, wherein the CH2-CH3 is a first variant Fc domain; (b) a second monomer comprising VH1-CH1-hinge-CH2-CH3-domain linker-variant IL-15 sushi domain, wherein the variant IL-15 sushi domain comprises a cysteine residue wherein the CH2-CH3 is a second variant Fc domain; (c) a third monomer comprising a variant IL-15 domain comprising a cysteine residue; and (d) a fourth monomer comprising a light chain comprising VL-CL; wherein the variant IL-15 sushi domain and the variant IL-15 domain form a disulfide bond and the VH and VL form an antigen binding domain that binds human NKG2D. In some preferred embodiments, such targeted IL-15/IL-15Rα heterodimeric proteins bind human NKG2D.

In various aspects of the present invention, provided herein is a targeted IL-15/IL-15Rα heterodimeric protein comprising: (a) a first monomer comprising, from N- to C-terminal, a VH-CH1-domain linker-variant IL-15 domain-domain linker-CH2-CH3, wherein the CH2-CH3 is a first variant Fc domain; (b) a second monomer comprising, from N- to C-terminal, a VH-CH1-domain linker-variant IL-15 sushi domain-domain linker-CH2-CH3, wherein the CH2-CH3 is a first variant Fc domain; and (c) a third monomer comprising a light chain comprising VL-CL; wherein the VH and the VL form an antigen binding domain that binds human NKG2D. In some preferred embodiments, such targeted IL-15/IL-15Rαheterodimeric proteins bind human NKG2D.

In various aspects of the present invention, provided herein is a targeted IL-15/IL-15Rα heterodimeric protein comprising: (a) a first monomer comprising from N- to C-terminal, VH-CH1-domain linker-IL-15 sushi domain-domain linker-variant IL-15 domain-domain linker-CH2-CH3, wherein the CH2-CH3 is a first variant Fc domain; (b) a second monomer comprising a heavy chain comprising VH-CH1-hinge-CH2-CH3, wherein the CH2-CH3 is a second variant Fc domain; and (c) a third monomer comprising a light chain comprising VL-CL; wherein the VH and the VL form an antigen binding domain that binds human NKG2D.

In some embodiments, the first and the second Fc domains described herein have a set of amino acid substitutions selected from the group consisting of S267K/L368D/K370S:S267K/S364K/E357Q; S364K/E357Q:L368D/K370S; L368D/K370S:S364K; L368E/K370S:S364K; T411E/K360E/Q362E:D401K; L368D/K370S:S364K/E357L and K370S:S364K/E357Q, according to EU numbering. In some embodiments, the first and/or the second Fc domains have an additional set of amino acid substitutions comprising Q295E/N384D/Q418E/N421D, according to EU numbering. In other instances, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering. In some embodiments, the first and the second Fc domains have S364K/E357Q:L368D/K370S. In some embodiments, the variant Fc domains each comprise M428L/N434S. In some embodiments, the variant Fc domains each comprise E233P/L234V/L235A/G236del/S267K.

In some aspects, the IL-15 protein of the targeted IL-15/IL-15Rα heterodimeric protein described herein has one or more amino acid substitutions selected from the group consisting of N1D, N4D, D8N, D30N, D61N, E64Q, N65D, and Q108E. In some embodiments, the variant IL-15 domain comprises an amino acid substitution(s) selected from the group consisting of N1D, N4D, D8N, D30N, D61N, E64Q, N65D, Q108E, N1D/D61N, N1D/E64Q, N4D/D61N, N4D/E64Q, N4D/N65D, D8N/D61N, D8N/E64Q, E64Q/Q108E, N1D/N4D/D8N, D61N/E64Q/N65D, N1D/D61N/E64Q/Q108E, N4D/D61N/E64Q/Q108E, N4D/N65D, D30N/N65D, and D30N/E64Q/N65D. In certain embodiments, the variant IL-15 domain comprises amino acid substitutions selected from the group consisting of N4D/N65D, D30N/N65D, and D30N/E64Q/N65D.

In some embodiments, the VH and the VL that form an antigen binding domain which binds human NKG2D are selected from MS_H0L0, 1D7B4_H1L1, 6E5A7_H0L0, 6H7E7_H0L0, mAb E_H1L1, 11B2D10_H0L0, 16F31_H1L1, mAb D_H1L1, KYK1.0_H1L1, KYK2.0_H0L0, mAb A_H1L1, mAb A_H1L2, mAb A_H2L1, mAb A_H2L2, mAb B_H1L1, mAb B_H1L1.1, mAb B_H1L2, mAb B_H2L1, mAb B_H2L2, mAb B_H2L1.1, mAb B_H2L2, mAb B_H3L1, mAb B_H3L1.1, mAb B_H3L2, mAb C_H1L1, mAb C_H1L2, mAb C_H2L1, and mAb C_H2L2, as shown in FIG. 117A-FIG. 117C.

In some embodiments, NKG2D-targeted IL-15/IL-15Rα heterodimeric protein of the present invention is selected from the group consisting of XENP27195, XENP27197, XENP27615, XENP27616, XENP27617, XENP27618, XENP27619, XENP27620, XENP27621, XENP27622, XENP27623, XENP27624, XENP27625, XENP27626, XENP27627, XENP27628, XENP27629, XENP27630, XENP27631, XENP27632, XENP27633, XENP27634, XENP27635, XENP27636, XENP27637, XENP27638, XENP30592, and XENP31077.

In some embodiments, provided herein is a pharmaceutical composition comprising a heterodimeric protein selected from the group consisting of XENP27195, XENP27197, XENP27615, XENP27616, XENP27617, XENP27618, XENP27619, XENP27620, XENP27621, XENP27622, XENP27623, XENP27624, XENP27625, XENP27626, XENP27627, XENP27628, XENP27629, XENP27630, XENP27631, XENP27632, XENP27633, XENP27634, XENP27635, XENP27636, XENP27637, XENP27638, XENP30592, and XENP31077; and a pharmaceutically acceptable carrier.

IX. Nucleic Acids of the Invention

The invention further provides nucleic acid compositions encoding the targeted heterodimeric fusion proteins of the invention (or, in the case of a monomer Fc domain protein, nucleic acids encoding those as well).

As will be appreciated by those in the art, the nucleic acid compositions will depend on the format of the targeted heterodimeric fusion protein. Thus, for example, when the format requires three amino acid sequences, three nucleic acid sequences can be incorporated into one or more expression vectors for expression. Similarly, some formats only two nucleic acids are needed; again, they can be put into one or two expression vectors, or four or 5. As noted herein, some constructs have two copies of a light chain, for example.

As is known in the art, the nucleic acids encoding the components of the invention can be incorporated into expression vectors as is known in the art, and depending on the host cells used to produce the targeted IL-15/Rα-Fc fusion heterodimeric proteins of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g., CHO cells), finding use in many embodiments.

In some embodiments, nucleic acids encoding each monomer, as applicable depending on the format, are each contained within a single expression vector, generally under different or the same promoter controls. In embodiments of particular use in the present invention, each of these two or three nucleic acids is contained on a different expression vector. As shown herein and in U.S. Provisional Application No. 62/025,931, U.S. Patent Application Publication No. 2015/0307629, and International Patent Publication No. WO 2015/149077 (all hereby incorporated by reference), different vector rations can be used to drive heterodimer formation. That is, surprisingly, while the proteins comprise a first monomer: second monomer:light chains (such as an embodiment that has three polypeptides comprising a heterodimeric antibody) in a 1:1:2 ratio, these are not the ratios that produce the best results.

The targeted IL-15/Rα-Fc fusion heterodimeric proteins of the invention are made by culturing host cells comprising the expression vector(s) as is well known in the art. Once produced, traditional fusion protein or antibody purification steps are done, including an ion exchange chromotography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that each monomer has a different pI and the heterodimer also has a distinct pI, thus facilitating isoelectric purification of the heterodimer (e.g., anionic exchange chromatography, cationic exchange chromatography). These substitutions also aid in the determination and monitoring of any contaminating homodimers post-purification (e.g., IEF gels, cIEF, and analytical IEX columns).

X. Biological and Biochemical Functionality of Targeted IL-15/IL-15Rα x Antigen Binding Domain Heterodimeric Fusion Proteins Generally the targeted IL-15/IL-15Rα x antigen binding domain heterodimeric fusion proteins of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g., presence of ICOS+CD4+ T cells following ipilimumab treatment) along with other measurements such as tumor burden, size, invasiveness, lymph node (LN) involvement, metastasis, etc. can be done. Thus, any or all of the following can be evaluated: the inhibitory effects of PVRIG on CD4+ T cell activation or proliferation, CD8+T (CTL) cell activation or proliferation, CD8+ T cell-mediated cytotoxic activity and/or CTL mediated cell depletion, NK cell activity and NK mediated cell depletion, the potentiating effects of checkpoints on Treg cell differentiation and proliferation and Treg- or myeloid derived suppressor cell (MDSC)-mediated immunosuppression or immune tolerance, and/or the effects of the checkpoints on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and $^3$H-thymidine incorporation method.

In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are performed as is known in the art.

In general, protein expression measurements are also similarly performed as is known in the art.

In some embodiments, assessment of treatment is performed by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, calcein-AM assay, luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

A. Assays to Measure Efficacy and Potency

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in $\alpha\beta$ and/or $\gamma\delta$ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases $\alpha\beta$ and/or $\gamma\delta$ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7, etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, $^{15}$Cr release, calcein AM, or by flow cytometry based assays like for an example CFSE dilution or propidium iodide staining, etc. An increase in activity indicates immunostimulatory activity. Appropriate increases in activity are outlined below.

In one embodiment, the signaling pathway assay measures increases or decreases in stimulation of cytotoxic or cytostatic effect on cancer cells as measured for an example by cytotoxicity assays such as for an example MTT, $^{15}$Cr release, calcein AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, $^{15}$Cr release, calcein AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, $^{15}$Cr release, calcein AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFN$\gamma$, TNF-$\alpha$, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g., IFN$\gamma$ and TNF), and cell surface receptor expression (e.g., CD25) would be indicative of immune modulation that would be consistent with enhanced killing of cancer cells.

In one embodiment, $\gamma\delta$ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an IL-15/IL-15Rα x antigen binding domain heterodimeric fusion protein of the invention. Similarly, increases of at least one-, two-, three-, four- or five-fold as compared to reference or control samples show efficacy.

XI. Checkpoint Blockade Antibodies

In some embodiments, the NKG2D-targeted IL-15/Rα-Fc fusion proteins described herein are combined with other therapeutic agents including checkpoint blockade antibodies, such as but not limited to, a PD-1 inhibitor, a TIM3 inhibitor, a CTLA4 inhibitor, a PD-L1 inhibitor, a TIGIT inhibitor, a LAG3 inhibitor, or a combination thereof.

A. Anti-PD1 Antibodies

In some embodiments, an IL-15/Rα-Fc fusion proteins described herein can be administered to a subject with cancer in combination with a checkpoint blockage antibody, e.g., an anti-PD-1 antibody. In some cases, the anti-PD-1 antibody includes XENP16432 (a bivalent anti-PD-1 mAb based on nivolumab with ablated effector function; amino acid sequence of XENP16432 is depicted in FIG. 12).

Exemplary non-limiting anti-PD-1 antibody molecules are disclosed in US 2015/0210769, published on Jul. 30, 2015, entitled "Antibody Molecules to PD-1 and Uses Thereof," incorporated by reference in its entirety.

In one embodiment, the anti-PD-1 antibody molecule includes at least one or two heavy chain variable domain (optionally including a constant region), at least one or two light chain variable domain (optionally including a constant region), or both, comprising the amino acid sequence of BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1; or a sequence substantially identical (e.g., at least 80%, 85%, 90%, 92%, 95%, 97%, 98%, 99% or higher identical) to any of the aforesaid sequences. The anti-PD-1 antibody molecule, optionally, comprises a leader sequence from a heavy chain, a light chain, or both, as shown in Table 4 of US 2015/0210769; or a sequence substantially identical thereto.

In yet another embodiment, the anti-PD-1 antibody molecule includes at least one, two, or three complementarity determining regions (CDRs) from a heavy chain variable region and/or a light chain variable region of an antibody described herein, e.g., an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-1 antibody molecule includes at least one, two, or three CDRs (or collectively all of the CDRs) from a heavy chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-PD-1 antibody molecule includes at least one, two, or three CDRs (or collectively all of the CDRs) from a light chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-1 antibody molecule includes a substitution in a light chain CDR, e.g., one or more substitutions in a CDR1, CDR2 and/or CDR3 of the light chain. In one embodiment, the anti-PD-1 antibody molecule includes a substitution in the light chain CDR3 at position 102 of the light variable region, e.g., a substitution of a cysteine to tyrosine, or a cysteine to serine residue, at position 102 of the light variable region according to Table 1 (e.g., SEQ ID NO: 16 or 24 for murine or chimeric, unmodified; or any of SEQ ID NOs: 34, 42, 46, 54, 58, 62, 66, 70, 74, or 78 for a modified sequence).

In another embodiment, the anti-PD-1 antibody molecule includes at least one, two, three, four, five or six CDRs (or collectively all of the CDRs) from a heavy and light chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In one embodiment, the anti-PD-1 antibody molecule includes:

(a) a heavy chain variable region (VH) comprising a VHCDR1 amino acid sequence of SEQ ID NO: 4, a VHCDR2 amino acid sequence of SEQ ID NO: 5, and a VHCDR3 amino acid sequence of SEQ ID NO: 3; and a light chain variable region (VL) comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769;

(b) a VH comprising a VHCDR1 amino acid sequence chosen from SEQ ID NO: 1; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769;

(c) a VH comprising a VHCDR1 amino acid sequence of SEQ ID NO: 224, a VHCDR2 amino acid sequence of SEQ ID NO: 5, and a VHCDR3 amino acid sequence of SEQ ID NO: 3; and a VL comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769; or (d) a VH comprising a VHCDR1 amino acid sequence of SEQ ID NO: 224; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769.

In another embodiment, the anti-PD-1 antibody molecule comprises (i) a heavy chain variable region (VH) comprising a VHCDR1 amino acid sequence chosen from SEQ ID NO: 1, SEQ ID NO: 4, or SEQ ID NO: 224; a VHCDR2 amino acid sequence of SEQ ID NO: 2 or SEQ ID NO: 5; and a VHCDR3 amino acid sequence of SEQ ID NO: 3; and (ii) a light chain variable region (VL) comprising a VLCDR1 amino acid sequence of SEQ ID NO: 10 or SEQ ID NO: 13, a VLCDR2 amino acid sequence of SEQ ID NO: 11 or SEQ ID NO: 14, and a VLCDR3 amino acid sequence of SEQ ID NO: 32 or SEQ ID NO: 33, each disclosed in Table 1 of US 2015/0210769.

In other embodiments, the PD-1 inhibitor is an anti-PD-1 antibody chosen from nivolumab, pembrolizumab, or pidilizumab.

In some embodiments, the anti-PD-1 antibody is nivolumab. Alternative names for nivolumab include MDX-1106, MDX-1106-04, ONO-4538, or BMS-936558. In some embodiments, the anti-PD-1 antibody is Nivolumab (CAS Registry Number: 946414-94-4). Nivolumab is a fully human IgG4 monoclonal antibody which specifically blocks PD1. Nivolumab (clone 5C4) and other human monoclonal antibodies that specifically bind to PD1 are disclosed in U.S. Pat. No. 8,008,449 and WO2006/121168. In one embodiment, the inhibitor of PD-1 is nivolumab, and having a sequence disclosed herein (or a sequence substantially identical or similar thereto, e.g., a sequence at least 85%, 90%, 95% identical or higher to the sequence specified). In some embodiments, the anti-PD-1 antibody is pembrolizumab. Pembrolizumab (also referred to as lambrolizumab, MK-3475, MK03475, SCH-900475 or KEYTRUDA®; Merck) is a humanized IgG4 monoclonal antibody that binds to PD-1. Pembrolizumab and other humanized anti-PD-1 antibodies are disclosed in Hamid, O. et al. (2013) *New England Journal of Medicine* 369 (2): 134-44, U.S. Pat. No. 8,354,509 and WO2009/114335.

In one embodiment, the inhibitor of PD-1 is pembrolizumab disclosed in, e.g., U.S. Pat. No. 8,354,509 and WO 2009/114335, and having a sequence disclosed herein (or a sequence substantially identical or similar thereto, e.g., a sequence at least 85%, 90%, 95% identical or higher to the sequence specified).

In some embodiments, the anti-PD-1 antibody is pidilizumab. Pidilizumab (CT-011; Cure Tech) is a humanized IgG1k monoclonal antibody that binds to PD1. Pidilizumab and other humanized anti-PD-1 monoclonal antibodies are disclosed in U.S. Pat. No. 8,747,847 and WO2009/101611.

Other anti-PD1 antibodies include AMP 514 (Amplimmune), among others, e.g., anti-PD1 antibodies disclosed in U.S. Pat. No. 8,609,089, US 2010028330, and/or US 20120114649.

In some embodiments, the PD-1 inhibitor is an immunoadhesin (e.g., an immunoadhesin comprising an extracellular or PD-1 binding portion of PD-L1 or PD-L2 fused to a constant region (e.g., an Fc region of an immunoglobulin sequence). In some embodiments, the PD-1 inhibitor is AMP-224 (B7-DCIg; Amplimmune; e.g., disclosed in WO2010/027827 and WO2011/066342), is a PD-L2 Fc fusion soluble receptor that blocks the interaction between PD-1 and B7-H1.

In some embodiments, anti-PD-1 antibodies can be used in combination with an IL-15/Rα Fc fusion protein of the invention. There are several anti-PD-1 antibodies including, but not limited to, two currently FDA approved antibodies, pembrolizumab and nivolizumab, as well as those in clinical testing currently, including, but not limited to, tislelizumab, Sym021, REGN2810 (developed by Rengeneron), JNJ-63723283 (developed by J and J), SHR-1210, pidilizumab, AMP-224, MEDIo680, PDR001 and CT-001, as well as others outlined in Liu et al., J. Hemat. & Oncol. (2017)10: 136, the antibodies therein expressly incorporated by reference.

In some embodiments, an NKG2D-targeted IL-15/Rα Fc fusion protein described herein can be used in combination with a PD-1 inhibitor (e.g., an anti-PD-1 antibody). In certain embodiments, an IL-15/Rα Fc fusion protein (e.g., XENP24113, XENP24306, XENP23557, or XENP24045) described herein is administered in combination with an anti-PD-1 antibody.

B. Anti-TIM3 Antibodies

Exemplary non-limiting anti-TIM-3 antibody molecules are disclosed in US 2015/0218274, published on Aug. 6, 2015, entitled "Antibody Molecules to TIM-3 and Uses Thereof," incorporated by reference in its entirety.

In one embodiment, the anti-TIM-3 antibody molecule includes at least one or two heavy chain variable domain (optionally including a constant region), at least one or two light chain variable domain (optionally including a constant region), or both, comprising the amino acid sequence of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences. The anti-TIM-3 antibody molecule, optionally, comprises a leader sequence from a heavy chain, a light chain, or both, as shown in US 2015/0218274; or a sequence substantially identical thereto.

In yet another embodiment, the anti-TIM-3 antibody molecule includes at least one, two, or three complementarity determining regions (CDRs) from a heavy chain variable region and/or a light chain variable region of an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences.

In yet another embodiment, the anti-TIM-3 antibody molecule includes at least one, two, or three CDRs (or collectively all of the CDRs) from a heavy chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Table 1-4.

In yet another embodiment, the anti-TIM-3 antibody molecule includes at least one, two, or three CDRs (or collectively all of the CDRs) from a light chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Tables 1-4. In certain embodiments, the anti-TIM-3 antibody molecule includes a substitution in a light chain CDR, e.g., one or more substitutions in a CDR1, CDR2 and/or CDR3 of the light chain.

In another embodiment, the anti-TIM-3 antibody molecule includes at least one, two, three, four, five or six CDRs (or collectively all of the CDRs) from a heavy and light chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Tables 1-4.

In one embodiment, the anti-TIM-3 antibody molecule includes:

(a) a heavy chain variable region (VH) comprising a VHCDR1 amino acid sequence chosen from SEQ ID NO: 9; a VHCDR2 amino acid sequence of SEQ ID NO: 10; and a VHCDR3 amino acid sequence of SEQ ID NO: 5; and a light chain variable region ($V_L$) comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274;

(b) a VH comprising a VHCDR1 amino acid sequence chosen from SEQ ID NO: 3; a VHCDR2 amino acid sequence of SEQ ID NO: 4; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274;

(c) a VH comprising a VHCDR1 amino acid sequence chosen from SEQ ID NO: 9; a VHCDR2 amino acid sequence of SEQ ID NO: 25; and a VHCDR3 amino acid sequence of SEQ ID NO: 5; and a VL comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274;

(d) a VH comprising a VHCDR1 amino acid sequence chosen from SEQ ID NO: 3; a VHCDR2 amino acid sequence of SEQ ID NO: 24; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274;

(e) a VH comprising a VHCDR1 amino acid sequence chosen from SEQ ID NO: 9; a VHCDR2 amino acid sequence of SEQ ID NO: 31; and a VHCDR3 amino acid sequence of SEQ ID NO: 5; and a VL comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274; or (f) a VH comprising a VHCDR1 amino acid sequence chosen from SEQ ID NO: 3; a VHCDR2 amino acid sequence of SEQ ID NO: 30; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274.

Exemplary anti-TIM-3 antibodies are disclosed in U.S. Pat. No. 8,552,156, WO 2011/155607, EP 2581113 and U.S. Publication No.: 2014/044728, and include Sym023 (in clinical development for Symphogen), TSR-22 (in clinical development for Tesaro), LY3321367, in clinical development for Eli Lilly), BGTB-A425 (in clinical development for BeiGene), MBG453 (in clinical development for Novartis) and INCAGN02390 (in clinical development for Incyte).

In some embodiments, anti-TIM-3 antibodies can be used in combination an IL-15/Rα Fc fusion protein of the invention. There are several TIM-3 antibodies in clinical development, including, but not limited to, MBG453 and TSR-022.

In some embodiments, an IL-15/Rα Fc fusion protein described herein can be used in combination with a TIM-3 inhibitor (e.g., an anti-TIM3 antibody). In certain embodiments, an IL-15/Rα Fc fusion protein (e.g., XENP24113, XENP24306, XENP23557, or XENP24045) described herein is administered in combination with an anti-TIM3 antibody.

C. Anti-CTLA4 Antibodies

Exemplary anti-CTLA4 antibodies include tremelimumab (IgG2 monoclonal antibody available from Pfizer, formerly known as ticilimumab, CP-675,206); and ipilimumab (CTLA-4 antibody, also known as MDX-010, CAS No. 477202-00-9). Other exemplary anti-CTLA-4 antibodies are disclosed, e.g., in U.S. Pat. No. 5,811,097.

In one embodiment, the anti-CTLA4 antibody is ipilimumab disclosed in, e.g., U.S. Pat. Nos. 5,811,097, 7,605,238, WO00/32231 and WO97/20574, and having a sequence disclosed herein (or a sequence substantially identical or similar thereto, e.g., a sequence at least 85%, 90%, 95% identical or higher to the sequence specified).

In one embodiment, the anti-CTLA4 antibody is tremelimumab disclosed in, e.g., U.S. Pat. No. 6,682,736 and WO00/37504, and having a sequence disclosed herein (or a sequence substantially identical or similar thereto, e.g., a sequence at least 85%, 90%, 95% identical or higher to the sequence specified).

In some embodiments, anti-CTLA-4 antibodies can be used in combination with an IL-15/Rα Fc fusion protein of the invention. Thus, suitable anti-CTLA-4 antibodies for use in combination therapies as outlined herein include, but are not limited to, one currently FDA approved antibody ipilimumab, and several more in development, including CP-675,206 and AGEN-1884.

In some embodiments, an IL-15/Rα Fc fusion protein described herein can be used in combination with a CTLA-4 inhibitor (e.g., an anti-CTLA-4 antibody). In certain embodiments, an IL-15/Rα Fc fusion protein (e.g., XENP24113, XENP24306, XENP23557, or XENP24045) described herein is administered in combination with an anti-CTLA-4 antibody.

D. Anti-PD-L1 Antibodies

Exemplary non-limiting anti-PD-L1 antibody molecules are disclosed in US 2016/0108123, published on Apr. 21, 2016, entitled "Antibody Molecules to PD-L1 and Uses Thereof," incorporated by reference in its entirety.

In one embodiment, the anti-PD-L1 antibody molecule includes at least one or two heavy chain variable domain (optionally including a constant region), at least one or two light chain variable domain (optionally including a constant region), or both, comprising the amino acid sequence of any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-O; or as described in Table 1 of US 2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-L1 antibody molecule includes at least one, two, or three complementarity determining regions (CDRs) from a heavy chain variable region and/or a light chain variable region of an antibody described herein, e.g., an antibody chosen from any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-O; or as described in Table 1 of US 2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-L1 antibody molecule includes at least one, two, or three CDRs (or collectively all of the CDRs) from a heavy chain variable region comprising an amino acid sequence shown in Table 1 of US 2016/0108123, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-PD-L1 antibody molecule includes at least one, two, or three CDRs (or collectively all of the CDRs) from a light chain variable region comprising an amino acid sequence shown in Table 1 of US 2016/0108123, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-L1 antibody molecule includes a substitution in a light chain CDR, e.g., one or more substitutions in a CDR1, CDR2 and/or CDR3 of the light chain.

In another embodiment, the anti-PD-L1 antibody molecule includes at least one, two, three, four, five or six CDRs (or collectively all of the CDRs) from a heavy and light chain variable region comprising an amino acid sequence shown in Table 1, or encoded by a nucleotide sequence shown in Table 1 of US 2016/0108123. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In one embodiment, the anti-PD-L1 antibody molecule includes:

(i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 2; and a VHCDR3 amino acid sequence of SEQ ID NO: 3, each disclosed in Table 1 of US 2016/0108123; and (ii) a light chain variable region (VL) including a VLCDR1 amino acid sequence of SEQ ID NO: 9, a VLCDR2 amino acid sequence of SEQ ID NO: 10, and a VLCDR3 amino acid sequence of SEQ ID NO: 11, each disclosed in Table 1 of US 2016/0108123.

In another embodiment, the anti-PD-L1 antibody molecule includes:

(i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 5, and a VHCDR3 amino acid sequence of SEQ ID NO: 3, each disclosed in Table 1 of US 2016/0108123; and (ii) a light chain variable region (VL) including a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Table 1 of US 2016/0108123.

In one embodiment, the anti-PD-L1 antibody molecule comprises the VHCDR1 amino acid sequence of SEQ ID NO: 1. In another embodiment, the anti-PD-L1 antibody molecule comprises the VHCDR1 amino acid sequence of SEQ ID NO: 4. In yet another embodiment, the anti-PD-L1 antibody molecule comprises the VHCDR1 amino acid sequence of SEQ ID NO: 195, each disclosed in Table 1 of US 2016/0108123.

In some embodiments, the PD-L1 inhibitor is an antibody molecule. In some embodiments, the anti-PD-L1 inhibitor is chosen from YW243.55.570, MPDL3280A, MEDI-4736, MSB-0010718C, MDX-1105, atezolizumab, durbalumab, avelumab, or BMS936559.

In some embodiments, the anti-PD-L1 antibody is atezolizumab. Atezolizumab (also referred to as MPDL3280A and Atezo®; Roche) is a monoclonal antibody that binds to PD-L1. Atezolizumab and other humanized anti-PD-L1 antibodies are disclosed in U.S. Pat. No. 8,217,149, and having a sequence disclosed herein (or a sequence substantially identical or similar thereto, e.g., a sequence at least 85%, 90%, 95% identical or higher to the sequence specified).

In some embodiments, the anti-PD-L1 antibody is avelumab. Avelumab (also referred to as A09-246-2; Merck Serono) is a monoclonal antibody that binds to PD-L1. Avelumab and other humanized anti-PD-L1 antibodies are disclosed in U.S. Pat. No. 9,324,298 and WO2013/079174, and having a sequence disclosed herein (or a sequence substantially identical or similar thereto, e.g., a sequence at least 85%, 90%, 95% identical or higher to the sequence specified).

In some embodiments, the anti-PD-L1 antibody is durvalumab. Durvalumab (also referred to as MEDI4736; AstraZeneca) is a monoclonal antibody that binds to PD-L1.

Durvalumab and other humanized anti-PD-L1 antibodies are disclosed in U.S. Pat. No. 8,779,108, and having a sequence disclosed herein (or a sequence substantially identical or similar thereto, e.g., a sequence at least 85%, 90%, 95% identical or higher to the sequence specified).

In some embodiments, the anti-PD-L1 antibody is BMS-936559. BMS-936559 (also referred to as MDX-1105; BMS) is a monoclonal antibody that binds to PD-L1. BMS-936559 and other humanized anti-PD-L1 antibodies are disclosed in U.S. Pat. No. 7,943,743 and WO2007005874, and having a sequence disclosed herein (or a sequence substantially identical or similar thereto, e.g., a sequence at least 85%, 90%, 95% identical or higher to the sequence specified).

In some embodiments, anti-PD-L1 antibodies can be used in combination with an IL-15/RαFc fusion protein of the invention. There are several anti-PD-L1 antibodies including three currently FDA approved antibodies, atezolizumab, avelumab, durvalumab, as well as those in clinical testing currently, including, but not limited to, LY33000054 and CS1001, as well as others outlined in Liu et al., J. Hemat. & Oncol. (2017)10:136, the antibodies therein expressly incorporated by reference.

In some embodiments, an IL-15/Rα heterodimeric fusion protein described herein can be used in combination with a PD-L1 or PD-L2 inhibitor (e.g., an anti-PD-L1 antibody).

E. Anti-TIGIT Antibodies

In some embodiments, the anti-TIGIT antibody is OMP-313M32. OMP-313M32 (OncoMed Pharmaceuticals) is a monoclonal antibody that binds to TIGIT. OMP-313M32 and other humanized anti-TIGIT antibodies are disclosed in US20160376365 and WO2016191643, and having a sequence disclosed herein (or a sequence substantially identical or similar thereto, e.g., a sequence at least 85%, 90%, 95% identical or higher to the sequence specified).

In some embodiments, the anti-TIGIT antibody is BMS-986207. BMS-986207 (also referred to as ONO-4686; Bristol-Myers Squibb) is a monoclonal antibody that binds to TIGIT. BMS-986207 and other humanized anti-TIGIT antibodies are disclosed in US20160176963 and WO2016106302, and having a sequence disclosed herein (or a sequence substantially identical or similar thereto, e.g., a sequence at least 85%, 90%, 95% identical or higher to the sequence specified).

In some embodiments, the anti-TIGIT antibody is MTIG7192. MTIG7192 (Genentech) is a monoclonal antibody that binds to TIGIT. MTIG7192 and other humanized anti-TIGIT antibodies are disclosed in US2017088613, WO2017053748, and WO2016011264, and having a sequence disclosed herein (or a sequence substantially identical or similar thereto, e.g., a sequence at least 85%, 90%, 95% identical or higher to the sequence specified).

In some embodiments, anti-TIGIT antibodies can be used in combination with an IL-15/Rα Fc fusion protein of the invention. There are several TIGIT antibodies in clinical development, BMS-986207 (in clinical development with BMS), OMP-313M32 (in clinical development with OncoMed), MTIG7192A (in clinical development with Genentech), and AB154 (in clinical development with Arcus Biosciences).

In some embodiments, an IL-15/Rα Fc fusion protein described herein can be used in combination with a TIGIT inhibitor (e.g., an anti-TIGIT antibody). In certain embodiments, an IL-15/Rα Fc fusion protein (e.g., XENP24113, XENP24306, XENP23557, or XENP24045) described herein is administered in combination with an anti-TIGIT antibody.

In some embodiments, anti-TIGIT antibodies can be used in combination with XENP24306, including, but not limited to, BMS-986207 (in clinical development with BMS), OMP-313M32 (in clinical development with OncoMed), MTIG7192A (in clinical development with Genentech), and AB154 (in clinical development with Arcus Biosciences).

F. Anti-LAG3 Antibodies

Exemplary non-limiting anti-LAG-3 antibody molecules are disclosed in US 2015/0259420 published on Sep. 17, 2015, entitled "Antibody Molecules to LAG-3 and Uses Thereof," incorporated by reference in its entirety.

In one embodiment, the anti-LAG-3 antibody molecule includes at least one or two heavy chain variable domain (optionally including a constant region), at least one or two light chain variable domain (optionally including a constant region), or both, comprising the amino acid sequence of any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-LAG-3 antibody molecule includes at least one, two, or three complementarity determining regions (CDRs) from a heavy chain variable region and/or a light chain variable region of an antibody described herein, e.g., an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-LAG-3 antibody molecule includes at least one, two, or three CDRs (or collectively all of the CDRs) from a heavy chain variable region comprising an amino acid sequence shown in Table 1 of US 2015/0259420, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-LAG-3 antibody molecule includes at least one, two, or three CDRs (or collectively all of the CDRs) from a light chain variable region comprising an amino acid sequence shown in Table 1 of US 2015/0259420, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-L1 antibody molecule includes a substitution in a light chain CDR, e.g., one or more substitutions in a CDR1, CDR2 and/or CDR3 of the light chain.

In another embodiment, the anti-LAG-3 antibody molecule includes at least one, two, three, four, five or six CDRs (or collectively all of the CDRs) from a heavy and light chain variable region comprising an amino acid sequence shown in Table 1, or encoded by a nucleotide sequence shown in Table 1 of US 2015/0259420. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In one embodiment, the anti-LAG-3 antibody molecule includes:

(i) a heavy chain variable region (VH) including a VHCDR1 amino acid sequence chosen from SEQ ID NO: 1, SEQ ID NO: 4 or SEQ ID NO: 286; a VHCDR2 amino acid sequence of SEQ ID NO: 2; and a VHCDR3 amino acid sequence of SEQ ID NO: 3, each disclosed in Table 1 of US 2015/0259420; and (ii) a light chain variable region (VL) including a VLCDR1 amino acid sequence of SEQ ID NO: 10, a VLCDR2 amino acid sequence of SEQ ID NO: 11, and a VLCDR3 amino acid sequence of SEQ ID NO: 12, each disclosed in Table 1 of US 2015/0259420.

In another embodiment, the anti-LAG-3 antibody molecule includes:

(i) a heavy chain variable region (VH) including a VHCDR1 amino acid sequence chosen from SEQ ID NO: 1, SEQ ID NO: 4 or SEQ ID NO: 286; a VHCDR2 amino acid sequence of SEQ ID NO: 5, and a VHCDR3 amino acid sequence of SEQ ID NO: 3, each disclosed in Table 1 of US 2015/0259420; and (ii) a light chain variable region (VL) including a VLCDR1 amino acid sequence of SEQ ID NO: 13, a VLCDR2 amino acid sequence of SEQ ID NO: 14, and a VLCDR3 amino acid sequence of SEQ ID NO: 15, each disclosed in Table 1 of US 2015/0259420.

In one embodiment, the anti-LAG-3 antibody molecule comprises the VHCDR1 amino acid sequence of SEQ ID NO: 1. In another embodiment, the anti-LAG-3 antibody molecule comprises the VHCDR1 amino acid sequence of SEQ ID NO: 4. In yet another embodiment, the anti-LAG-3 antibody molecule comprises the VHCDR1 amino acid sequence of SEQ ID NO: 286, each disclosed in Table 1 of US 2015/0259420.

In some embodiments, the anti-LAG-3 antibody is BMS-986016. BMS-986016 (also referred to as BMS986016; Bristol-Myers Squibb) is a monoclonal antibody that binds to LAG-3. BMS-986016 and other humanized anti-LAG-3 antibodies are disclosed in US 2011/0150892, WO2010/019570, and WO2014/008218.

In some embodiments, the anti-LAG3 antibody is LAG525. LAG525 (also referred to as IMP701; Novartis) is a monoclonal antibody that binds to LAG3. LAG525 and other humanized anti-LAG3 antibodies are disclosed in U.S. Pat. No. 9,244,059 and WO2008132601, and having a sequence disclosed herein (or a sequence substantially identical or similar thereto, e.g., a sequence at least 85%, 90%, 95% identical or higher to the sequence specified).

Other exemplary anti-LAG3 antibodies are disclosed, e.g., in US2011150892 and US2018066054.

In some embodiments, anti-LAG-3 antibodies can be used in combination with an IL-15/Rα Fc fusion protein of the invention. There are several anti-LAG-3 antibodies in clinical development including REGN3767, by Regeneron, TSR-033 (Tesaro), BMS-986016 (BMS) and Sym022 (Symphogen).

In some embodiments, an IL-15/Rα Fc fusion protein described herein can be used in combination with a LAG3 inhibitor (e.g., an anti-LAG3 antibody). In certain embodiments, an IL-15/Rα Fc fusion protein (e.g., XENP24113, XENP24306, XENP23557, or XENP24045) described herein is administered in combination with an anti-LAG3 antibody.

In some embodiments, anti-LAG-3 antibodies can be used in combination with XENP24306, including, but not limited to, REGN3767, by Regeneron, TSR-033 (Tesaro), BMS-986016 (BMS) and Sym022 (Symphogen).

XII. Combination Therapy

In some aspects, any one of the NKG2D targeted IL-15/Rα Fc fusion proteins described herein (e.g., those in FIGS. 122A-122N, 138A-138C, and 139A-139J) is administered in combination with another therapeutic agent. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

The NKG2D targeted IL-15/Rα Fc fusion protein described herein and the at least one additional therapeutic agent can be administered simultaneously, in the same or in separate compositions, or sequentially. For sequential administration, the NKG2D targeted IL-15/Rα Fc fusion protein described herein can be administered first, and the additional agent can be administered second, or the order of administration can be reversed.

The NKG2D targeted IL-15/Rα Fc fusion protein outlined herein and/or other therapeutic agents, procedures or modalities can be administered during periods of active disorder, or during a period of remission or less active disease. The NKG2D targeted IL-15/Rα Fc fusion protein can be administered before the other treatment, concurrently with the treatment, post-treatment, or during remission of the disorder.

When administered in combination, the NKG2D targeted IL-15/Rα Fc fusion protein and the additional agent (e.g., second or third agent), or all, can be administered in an amount or dose that is lower or the same than the amount or dosage of each agent used individually, e.g., as a monotherapy. In some embodiments, the administered amount or dosage of NKG2D targeted IL-15/Rα Fc fusion protein, the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the NKG2D targeted IL-15/Rα Fc fusion protein, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In further aspects, an NKG2D targeted IL-15/Rα Fc fusion protein described herein may be used in a treatment regimen in combination with chemotherapy, radiation, immunosuppressive agents, such as cyclosporin, azathioprine, methotrexate, mycophenolate, and FK506, antibodies directed against checkpoint inhibitors, or other immunoablative agents such as CAMPATH, other antibody therapies, cytoxan, fludarabine, cyclosporin, FK506, rapamycin, mycophenolic acid, steroids, FR90165, cytokines, and irradiation. peptide vaccine, such as that described in Izumoto et al. 2008 J Neurosurg 108:963-971.

In certain instances, compounds of the present invention are combined with other therapeutic agents, such as other anti-cancer agents, anti-allergic agents, anti-nausea agents (or anti-emetics), pain relievers, cytoprotective agents, and combinations thereof.

In one embodiment, any of the NKG2D targeted IL-15/Rα Fc fusion proteins described herein can be used in combination with a chemotherapeutic agent. Exemplary chemotherapeutic agents include an anthracycline (e.g., idarubicin, daunorubicin, doxorubicin (e.g., liposomal doxorubicin)), a anthracenedione derivative (e.g., mitoxantrone), a vinca alkaloid (e.g., vinblastine, vincristine, vindesine, vinorelbine), an alkylating agent (e.g., cyclophosphamide, dacarbazine, melphalan, ifosfamide, temozolomide), an immune cell antibody (e.g., alemtuzamab, gemtuzumab, rituximab, ofatumumab, tositumomab, brentuximab), an antimetabolite (including, e.g., folic acid antagonists, cytarabine, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide), a kinase inhibitor such as ibrutinib (e.g., Imbruvica), a corticosteroid (e.g., dexamethasone, prednisone), and CVP (a combination of cyclophosphamide, vincristine, and prednisone), CHOP (a combination of cyclophosphamide, hydroxydaunorubicin, Oncovin® (vincristine), and prednisone) with or without etoposide (e.g., VP-16), a combination of cyclophosphamide and pentostatin, a combination of chlorambucil and prednisone, a combination of fludarabine and cyclophosphamide, or another agent such as mechlorethamine hydrochloride (e.g. Mustargen), doxorubicin (Adriamycin®), methotrexate, oxaliplatin, or cytarabine (ara-C).

General chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

XIII. Treatments

Once made, the compositions of the invention find use in a number of oncology applications, by treating cancer, generally by promoting T cell activation (e.g., T cells are no longer suppressed) with the binding of the heterodimeric Fc fusion proteins of the invention.

Accordingly, the targeted IL-15/Rα-Fc fusion heterodimeric protein compositions of the invention find use in the treatment of these cancers.

A. Targeted Heterodimeric Protein Compositions for In Vivo Administration

In some embodiments, targeted heterodimeric proteins of the present invention are co-administered with a separate antibody. Co-administration can be performed simultaneously or sequentially, as will be appreciated by those in the art.

Formulations of antibodies used in accordance with the present invention are prepared for storage by mixing an antibody having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions. Acceptable carriers, buffers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

B. Administrative Modalities

The targeted heterodimeric proteins of the invention can be administered with a chemotherapeutic agent to a subject, in accord with known methods, such as intravenous administration as a bolus or by continuous infusion over a period of time. Administration of the bifunction heterodimer protein and a chemotherapeutic agent can be performed simultaneously or sequentially, as will be appreciated by those in the art C. Treatment Modalities In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomography (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the targeted IL-15/Rα-Fc fusion heterodimeric protein, antigen binding domain, or portions thereof are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound or composition to inhibit cell growth or to induce apoptosis by in vitro assays known to the skilled practitioner. A therapeutically effective amount of a therapeutic compound or composition may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the targeted IL-15/Rα-Fc fusion heterodimeric proteins used in the present invention depend on the disease or condition to be treated and may be determined by the persons skilled in the art.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in U.S. Patent Application Publication Nos. 2015/0307629, and 2014/0288275 and International Patent Publication No. WO2014/145806, all of which are expressly incorporated by reference in their entirety and particularly for the techniques outlined therein.

Example 1: IL-15/IL-15Rα Fc Fusion Proteins

1A: Engineering IL-15/Rα-Fc Fusion Proteins

In order to address the short half-life of IL-15/IL-15Rα heterodimers, the IL-15/IL-15Rα(sushi) complex was generated as a Fc fusion (hereon referred to as IL-15/Rα-Fc fusion proteins) with the goal of facilitating production and promoting FcRn-mediated recycling of the complex and prolonging half-life.

Plasmids coding for IL-15 or IL-15Rα sushi domain were constructed by standard gene synthesis, followed by subcloning into a pTT5 expression vector containing Fc fusion partners (e.g., constant regions as depicted in FIG. 8). Cartoon schematics of illustrative IL-15/Rα-Fc fusion protein formats are depicted in FIGS. 16A-16G.

Illustrative proteins of the IL-15/Rα-heteroFc format (FIG. 16A) include XENP20818 and XENP21475, sequences for which are depicted in FIG. 17. Illustrative proteins of the scIL-15/Rα-Fc format (FIG. 16B) include XENP21478 and XENP21993, sequences for which are depicted in FIG. 18. Illustrative proteins of the ncIL-15/Rα-Fc format (FIG. 16C) include XENP21479, XENP22366, and XENP24348 sequences for which are depicted in FIG. 19. An illustrative protein of the bivalent ncIL-15/Rα-Fc format (FIG. 16D) is XENP21978, sequences for which are depicted in FIG. 20. Sequences for an illustrative protein of the bivalent scIL-15/Rα-Fc format (FIG. 16E) are depicted in FIG. 21. Illustrative proteins of the Fc-ncIL-15/Rα format (FIG. 16F) are XENP22637 and XENP22638, sequences for which are depicted in FIG. 22. Sequences for an illustrative protein of the Fc-scIL-15/Rα format (FIG. 16G) are depicted in FIG. 23.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

IL-15/Rα-Fc fusion proteins in the various formats as described above were tested in a cell proliferation assay. Human PBMCs were treated with the test articles at the indicated concentrations. 4 days after treatment, the PBMCs were stained with anti-CD8-FITC (RPA-T8), anti-CD4-PerCP/Cγ5.5 (OKT4), anti-CD27-PE (M-T271), anti-CD56– BV421 (5.1H11), anti-CD16-BV421 (3G8), and anti-CD45RA-BV605 (Hi100) to gate for the following cell types: CD4+ T cells, CD8+ T cells, and NK cells (CD56+/CD16+). Ki67 is a protein strictly associated with cell proliferation, and staining for intracellular Ki67 was performed using anti-Ki67-APC (Ki-67) and Foxp3/Transcription Factor Staining Buffer Set (Thermo Fisher Scientific, Waltham, Mass.). The percentage of Ki67 on the above cell types was measured using FACS (depicted in FIGS. 24A-24C and 25A-25C). The various IL-15/Rα-Fc fusion proteins induced strong proliferation of CD8+ T cells and NK cells. Notably, differences in proliferative activity were dependent on the linker length on the IL-15-Fc side. In particular, constructs having no linker (hinge only), including XENP21471, XENP21474, and XENP21475, demonstrated weaker proliferative activity.

1B: IL-15/Rα-Fc Fusion Proteins with Engineered Disulfide Bonds

To further improve stability and prolong the half-life of IL-15/Rα-Fc fusion proteins, disulfide bonds were engineered into the IL-15/Rα interface. By examining the crystal structure of the IL-15/Rα complex, as well as by modeling using Molecular Operating Environment (MOE; Chemical Computing Group, Montreal, Quebec, Canada) software, it was predicted that residues at the IL-15/Rα interface may be substituted with cysteine in order to form covalent disulfide bonds, as depicted in FIG. 26. Additionally, up to three amino acids following the sushi domain in IL-15Rα were added to the C-terminus of IL-15Rα(sushi) as a scaffold for engineering cysteines (illustrative sequences for which are depicted in FIG. 27). Sequences for illustrative IL-15 and IL-15Rα(sushi) variants engineered with cysteines are respectively depicted in FIGS. 28 and 29.

Plasmids coding for IL-15 or IL-15Rα(sushi) were constructed by standard gene synthesis, followed by subcloning into a pTT5 expression vector containing Fc fusion partners (e.g., constant regions as depicted in FIG. 8). Residues identified as described above were substituted with cysteines by standard mutagenesis techniques. Cartoon schematics of IL-15/Rα-Fc fusion proteins with engineered disulfide bonds are depicted in FIGS. 30A-30D.

Illustrative proteins of the dsIL-15/Rα-heteroFc format (FIG. 30A) include XENP22013, XENP22014, XENP22015, and XENP22017, sequences for which are depicted in FIG. 31. Illustrative proteins of the dsIL-15/Rα-Fc format (FIG. 30B) include XENP22357, XENP22358, XENP22359, XENP22684, and XENP22361, sequences for which are depicted in FIG. 32. Illustrative protein of the bivalent dsIL-15/Rα-Fc format (FIG. 30C) include XENP22634, XENP22635, XENP22636 and XENP22687, sequences for which are depicted in FIG. 33. Illustrative proteins of the Fc-dsIL-15/Rα format (FIG. 30D) include XENP22639 and XENP22640, sequences for which are depicted in FIG. 34.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

After the proteins were purified, they were characterized by capillary isoelectric focusing (CEF) for purity and homogeneity. CEF was performed using LabChip GXII Touch HT (PerkinElmer, Waltham, Mass.) using Protein Express Assay LabChip and Protein Express Assay Reagent Kit carried out using the manufacturer's instructions. Samples were run in duplicate, one under reducing (with dithiothreitol) and the other under non-reducing conditions. Many of the disulfide bonds were correctly formed as indicated by denaturing non-reducing CEF, where the larger molecular weight of the covalent complex can be seen when compared to the controls without engineered disulfide bonds (FIG. 35).

The proteins were then tested in a cell proliferation assay. IL-15/Rα-Fc fusion proteins (with or without engineered disulfide bonds) or controls were incubated with PBMCs for 4 days. Following incubation, PBMCs were stained with anti-CD4-PerCP/Cγ5.5 (RPA-T4), anti-CD8-FITC (RPA- T8), anti-CD45RA-BV510 (HI100), anti-CD16-BV421 (3G8), anti-CD56-BV421 (HCD56), anti-CD27-PE (O323), and anti-Ki67-APC (Ki-67) to mark various cell populations and analyzed by FACS. Proliferation of NK cells, CD4+T cells, and CD8+ T cells as indicated by Ki67 expression are depicted in FIGS. 36A-36C. Each of the IL-15/Rα-Fc fusion proteins and the IL-15 control induced strong proliferation of NK cells, CD8+ T cells, and CD4+ T cells.

1C: IL-15/Rα-Fc Fusion Proteins Engineered for Lower Potency and Increased PK and Half-Life In order to further improve PK and prolong half-life, it was reasoned that decreasing the potency of IL-15 would decrease the antigen sink, and thus, increase the half-life. By examining the crystal structure of the IL-15:IL-2Rβ and IL-15:common gamma chain interfaces, as well as by modeling using MOE software, it was predicted that residues at these interfaces may be substituted in order to reduce potency. FIG. 37 depicts a structural model of the IL-15: receptor complexes showing locations of the predicted residues where isosteric substitutions (in order to reduce the risk of immunogenicity) were engineered. Sequences for illustrative IL-15 variants designed for reduced potency are depicted in FIG. 3.

Plasmids coding for IL-15 or IL-15Rα(sushi) were constructed by standard gene synthesis, followed by subcloning into a pTT5 expression vector containing Fc fusion partners (e.g., constant regions as depicted in FIGS. 8A-8D). Substitutions identified as described above were incorporated by standard mutagenesis techniques. Sequences for illustrative IL-15/Rα-Fc fusion proteins of the "IL-15/Rα-heteroFc" format engineered for reduced potency are depicted in FIGS. 39A-39E. Sequences for illustrative IL-15/Rα-Fc fusion proteins of the "scIL-15/Rα-Fc" format engineered for reduced potency are depicted in FIGS. 40A-40D. Sequences for illustrative IL-15/Rα-Fc fusion proteins of the "ncIL-15/Rα-Fc" format engineered for reduced potency are depicted in FIGS. 41A-41B. Sequences for illustrative ncIL-15/Rα heterodimers engineered for reduced potency are depicted in FIG. 42. Sequences for an illustrative IL-15/Rα-Fc fusion protein of the "bivalent ncIL-15/Rα-Fc" format engineered for reduced potency are depicted in FIG. 43. Sequences for illustrative IL-15/Rα-Fc fusion proteins of the "dsIL-15/Rα-Fc" format engineered for reduced potency are depicted in FIG. 44.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

1C(a): In Vitro Activity of Variant IL-15/Rα-Fc Fusion Proteins Engineered for Decreased Potency The variant IL-15/Rα-Fc fusion proteins were tested in a number of cell proliferation assays.

In a first cell proliferation assay, IL-15/Rα-Fc fusion proteins (with or without engineered substitutions) or control were incubated with PBMCs for 4 days. Following incubation, PBMCs were stained with anti-CD4-Evolve605 (SK-3), anti-CD8-PerCP/Cy5.5 (RPA-T8), anti-CD45RA-APC/Cy7 (HI100), anti-CD16-eFluor450 (CB16), anti-CD56– eFluor450 (TULY56), anti-CD3-FITC (OKT3), and anti-Ki67-APC (Ki-67) to mark various cell populations and analyzed by FACS. Proliferation of NK cells, CD8+ T cells, and CD4+ T cells as indicated by Ki67 expression are depicted in FIGS. 45-46. Most of the IL-15/Rα-Fc fusion proteins induced proliferation of each cell population; however, activity varied depending on the particular engineered substitutions.

In a second cell proliferation assay, IL-15/Rα-Fc fusion proteins (with or without engineered substitutions) were incubated with PBMCs for 3 days. Following incubation, PBMCs were stained with anti-CD3-FITC (OKT3), anti-CD4-Evolve604 (SK-3), anti-CD8-PerCP/Cy5.5 (RPA-T8), anti-CD16-eFluor450 (CB16), anti-CD56-eFluor450 (TULY56), anti-CD27-PE (O323), anti-CD45RA-APC/Cy7 (HI100) and anti-Ki67-APC (20Raj1) antibodies to mark various cell populations. Lymphocytes were first gated on the basis of side scatter (SSC) and forward scatter (FSC). Lymphocytes were then gated based on CD3 expression. Cells negative for CD3 expression were further gated based on CD16 expression to identify NK cells (CD16+). CD3+ T cells were further gated based on CD4 and CD8 expression to identify CD4+ T cells, CD8+ T cells, and γδ T cells (CD3+CD4−CD8−). The CD4+ and CD8+ T cells were gated for CD45RA expression. Finally, the proliferation of the various cell populations was determined based on percentage Ki67 expression, and the data are shown in FIGS. 47A-D. NK and CD8+ T cells are more sensitive than CD4+ T cells to IL-15/Rα-Fc fusion proteins, and as above, proliferative activity varied depending on the particular engineered substitutions. FIG. 47D shows the fold change in EC50 of various IL-15/Rα-Fc fusion proteins relative to control XENP20818. FIGS. 48A and 48B further depict the activation of lymphocytes following treatment with IL-15/Rα-Fc fusion proteins by gating for the expression of CD69 and CD25 (T cell activation markers) before and after incubation of PBMCs with XENP22821.

In a third experiment, additional variant IL-15/Rα-Fc fusion proteins were incubated with human PBMCs for 3 days at 37° C. Following incubation, PBMCs were stained with anti-CD3-FITC (OKT3), anti-CD4-SB600 (SK-3), anti-CD8-PerCP/Cy5.5 (RPA-T8), anti-CD45RA-APC/Cy7 (HI100), anti-CD16-eFluor450 (CB16), anti-CD25-PE (M-A251), and anti-Ki67-APC (Ki-67) to mark various cell populations and analyzed by FACS. Proliferation of CD8+ (CD45RA−) T cells, CD4+(CD45RA−) T cells, γδ T cells, and NK cells as indicated by Ki67 expression are depicted in FIGS. 49A-49D.

In a fourth experiment, human PBMCs were incubated with the additional IL-15/Rα-Fc variants at the indicated concentrations for 3 days. Following incubation, PBMCs were stained with anti-CD3-FITC (OKT3), anti-CD4 (SB600), anti-CD8-PerCP/Cy5.5 (RPA-T8), anti-CD16-eFluor450 (CB16), anti-CD25-PE (M-A251), anti-CD45RA-APC/Cy7 (HI100), and anti-Ki67-APC (Ki67) and analyzed by FACS. Percentage of Ki67 on CD8+ T cells, CD4+ T cells and NK cells following treatment are depicted in FIG. 50.

In a fifth experiment, variant IL-15/Rα-Fc fusion proteins were incubated with human PBMCs for 3 days at 37° C. Following incubation, cells were stained with anti-CD3-PE (OKT3), anti-CD4-FITC (RPA-T4), anti-CD8α-BV510 (SK1), anti-CD8β-APC (2ST8.5H7), anti-CD16-BV421 (3G8), anti-CD25-PerCP/Cy5.5 (M-A251), anti-CD45RA–APC/Cy7 (HI100), anti-CD56-BV605 (NCAM16.2), and anti-Ki67-PE/Cy7 (Ki-67) and analyzed by FACS. Percentage of Ki67 on CD8+ T cells, CD4+ T cells, γδ T cells, and NK cells are depicted in FIGS. 51A-51E.

In a sixth experiment, variant IL-15/Rα-Fc fusion proteins were incubated with human PBMCs for 3 days at 37°

C. Following incubation, cells were stained with anti-CD3-PE (OKT3), anti-CD4-FITC (RPA-T4), anti-CD8α-BV510 (SK1), anti-CD8β-APC (SIDI8BEE), anti-CD16-BV421 (3G8), anti-CD25-PerCP/Cγ5.5 (M-A251), anti-CD45RA–APC/Cγ7 (HI100), anti-CD56-BV605 (NCAM16.2), and anti-Ki67-PE/Cγ7 (Ki-67) and analyzed by FACS. Percentage of Ki67 on CD8+ T cells, CD4+ T cells, γδ T cells, and NK cells are depicted in FIGS. 52A-52E.

In a seventh experiment, variant IL-15/Rα-Fc fusion proteins were incubated with human PBMCs at the indicated concentrations for 3 days at 37° C. Following incubation, PBMCs were stained with anti-CD3-PE (OKT3), anti-CD4-FITC (RPA-T4), anti-CD8-APC (RPA-T8), anti-CD16-BV605 (3G8), anti-CD25-PerCP/Cγ5.5 (M-A251), anti-CD45RA– APC/Fire750 (HI100) and anti-Ki67-PE/Cγ7 (Ki-67) and analyzed by FACS. Percentage Ki67 on CD8+ T cells, CD4+ T cells, γδ T cells and NK (CD16+) cells are depicted in FIGS. 53A-D. The data show that the ncIL-15/Rα-Fc fusion protein XENP21479 is the most potent inducer of CD8+ T cell, CD4+ T cell, NK (CD16+) cell, and γδ T cell proliferation. Each of the scIL-15/Rα-Fc fusion proteins were less potent than XENP21479 in inducing proliferation, but differences were dependent on both the linker length, as well as the particular engineered substitutions.

In an eighth experiment, variant IL-15/Rα-Fc fusion proteins were incubated with human PBMCs at the indicated concentrations for 3 days at 37° C. Following incubation, PBMCs were stained with anti-CD3-PE (OKT3), anti-CD4-FITC (RPA-T4), anti-CD8-APC (RPA-T8), anti-CD16-BV605 (3G8), anti-CD25-PerCP/Cγ5.5 (M-A251), anti-CD45RA– APC/Fire750 (HI100) and anti-Ki67-PE/Cγ7 (Ki-67) and analyzed by FACS. Percentage Ki67 on CD8+ T cells, CD4+ T cells, γδ T cells and NK (CD16$^+$) cells are respectively depicted in FIGS. 54A-D. As above, the data show that the ncIL-15/Rα-Fc fusion protein XENP21479 is the most potent inducer of CD8+ T cell, CD4+ T cell, NK (CD16+) cell, and γδ T cell proliferation. Notably, introduction of Q108E substitution into the ncIL-15/Rα-Fc format (XENP24349) drastically reduces its proliferative activity in comparison to wildtype (XENP21479).

1C(b): PK of IL-15/Rα-Fc Fusion Proteins Engineered for Reduced Potency

In order to investigate if IL-15/Rα-Fc fusion proteins engineered for reduced potency had improved half-life and PK, these variants were examined in a PK study in C57BL/6 mice. Two cohorts of mice (5 mice per test article per cohort) were dosed with 0.1 mg/kg of the indicated test articles via IV-TV on Day 0. Serum was collected 60 minutes after dosing and then on Days 2, 4, and 7 for Cohort 1 and Days 1, 3, and 8 for Cohort 2. Serum levels of IL-15/Rα-Fc fusion proteins were determined using anti-IL-15 and anti-IL-15Rα antibodies in a sandwich ELISA. The results are depicted in FIG. 55. FIG. 56 depicts the correlation between potency and half-life of the test articles. As predicted, variants with reduced potency demonstrated substantially longer half-life. Notably, half-life was improved up to almost 9 days (see XENP22821 and XENP22822), as compared to 0.5 days for the wild-type control XENP20818.

Example 2: Engineering NKG2A and NKG2D-Targeted IL-15/Rα-Fc Fusions

One strategy by which tumors escape immune elimination is through downregulation of MHC class I in order to avoid recognition by T cells (Garrido, F et al., 2016). As a backup, NK cells can recognize cancer cells in the absence of MHC I, and in fact, may be sensitized the downregulation of MHC class I by tumor cells (Zamai, L et al., 2007). However, cancer patients have been found with reduced NK cell counts (Levy, E M et al., 2011). Accordingly, NKG2A and NKG2D-targeted constructs were generated with the aim to not only skew the IL-15/Rα-Fc fusions away from Tregs, but to also selectively target and expand NK cells.

2A: Engineering NKG2A and NKG2D-Targeted IL-15/Rα-Fc Fusions

The VH and VL sequences of monalizumab (as disclosed in U.S. Pat. No. 8,901,283, issued Dec. 2, 2014) was humanized and engineered in the Fab format for use as a component of proof of concept NKG2A-targeted IL-15/Rα-Fc fusions. The sequences for monalizumab (chimeric and humanized) in bivalent format are depicted in FIG. 58 as XENP24541 and XENP24542.

The VH and VL sequences of an anti-NKG2D (as disclosed in U.S. Pat. No. 7,879,985, issued Feb. 1, 2011) was engineered in the Fab format for use as a component of prototype NKG2D-targeted IL-15/Rα-Fc fusion. The sequence in bivalent mAb format is depicted in FIG. 59 as XENP24365.

NKG2A and NKG2D-targeted IL-15/Rα-Fc fusions were generated in the scIL-15/Rα x Fab format as depicted in FIG. 57D, which comprises a VH fused to the N-terminus of a heterodimeric Fc-region, with the other side comprising IL-15Rα(sushi) fused to IL-15 by a variable length linker (termed "scIL-15/Rα") fused to the N-terminus of the other side of the heterodimeric Fc-region, while a corresponding light chain is transfected separately as to form a Fab with the VH. Sequences for illustrative NKG2A-targeted IL-15/Rα-Fc fusions XENP24531, XENP24532 and XENP27146 are depicted in FIG. 60, and sequences for illustrative NKG2D-targeted IL-15/Rα-Fc fusions XENP24533, XENP24534, and XENP27145 are depicted in FIGS. 61A-61B.

Plasmids coding for the VH and VL sequences as described above, IL-15 and IL-15Rα(sushi) domains, light chain constant region, and heterodimeric constant regions (as depicted in FIG. 9) were constructed by Gibson assembly. Proteins were produced by transient transfection in HEK293E cells and were purified by a two-step purification process comprising Protein A chromatography followed by ion exchange chromatography.

2B: Activity of NKG2A-Targeted IL-15/Rα-Fc Fusions with IL-15 Potency Variants A one-arm scIL-15/Rα Fc fusion (XENP21993), NKG2A-targeted reduced potency scIL-15(N65D)/Rα (XENP24531), and NKG2A-targeted reduced potency scIL-15(Q108E)/Rα (XENP24532) which have anti-NKG2A Fab arms based on monalizumab were tested in a cell proliferation assay.

Human PBMCs were treated with the test articles at the indicated concentration. 3 days after treatment, the PBMCs were analyzed by FACS. Percentage of Ki67 on CD4+ T cells, CD8+ T cells, and NK cells are depicted in FIGS. 62A-62C for each test article. The data show that in comparison to XENP21993, XENP24531 and XENP24532 demonstrated decreased potency in proliferating CD4+ T cells, CD8+ T cells, and NK cells. Notably, XENP24532 demonstrated decreased efficacy in proliferating CD4+ T cells while maintaining efficacy in proliferating CD8+ T cells, in comparison to XENP24531. This suggests that even with the same NKG2A-targeting Fab arm, the potency of the scIL-15/Rαside impacts the potency in expanding various cell types.

2C: NKG2A and NKG2D-Targeted Reduced-Potency IL-15/Rα-Fc Fusions Show Selective Proliferation of NK Cells Human PBMCs were treated with the test articles at the indicated concentrations. 3 days after treatment, the PBMCs were first stained with anti-CD3-PerCP/Cγ5.5 (OKT3), anti-CD4-BV786 (RPA-T4), anti-CD8-PE/Cγ7 (SIDI8BEE), anti-CD16-BV421 (3G8), anti-CD56-BV605, and anti-CD45RA-APC/Cγ7 (HI100). Cells were washed again and stained with anti-FoxP3-AF488 (259D) and anti-Ki67-APC using eBioscience™ Foxp3/Transcription Factor Staining Buffer Set (Thermo Fisher Scientific, Waltham, Mass.). Lymphocytes were first identified by gating on the basis of SSC and FSC. The lymphocytes were then gated based on CD3 expression to identify NK cells (CD3-CD16+) and CD3+ T cells. The CD3+ T cells were then gated based on CD4 and CD8 to identify CD4+ and CD8+ T cells. CD4+ and CD8+ memory T cell subpopulations were then identified by further gating based on CD45RA. Finally, percentage of Ki67, a protein strictly associated with cell proliferation, on CD4+ T cells (CD3+CD4+CD45RA−), CD8+ T cells (CD3+CD8+CD45RA−), and NK cells was determined (depicted respectively in FIGS. 63A-C). The data show that the control "RSV-targeted" reduced-potency one-arm scIL-15 (N4D/N65D)/Rα-Fc XENP26007 has significantly reduced potency in proliferation of CD8+ and CD4+ T cells as well as NK cells, in comparison to XENP20818 (WT IL-15/Rα-Fc). Targeting with anti-NKG2A or anti-NKG2D Fab arms (as in XENP27145 and XENP27146) selectively induces proliferation of NK cells with no increase in potency on proliferating CD8+ and CD4+ T cells.

Following binding of cytokines to their receptors, Janus kinases (JAKs) associated with the receptors phosphorylate STAT proteins which then translocate into the nucleus to regulate further downstream processes. Therefore, phosphorylation of STAT proteins (in particular, STAT5, which include STAT5a and STAT5b) is one of the earliest signaling events triggered by IL-15 binding to its receptors.

Accordingly, in another experiment, induction of STAT5 phosphorylation was investigated on various lymphocyte populations by the NKG2A and NKG2D-targeted IL-15/Rα-Fc fusions. Human PBMCs were incubated with the following test articles at the indicated concentrations for 15 minutes at 37° C.: XENP20818 (WT IL-15/Rα-Fc), XENP24050, XENP27145, and XENP27146. To gate for various cell populations following incubation, PBMCs were stained with anti-CD3-BUV395 (UCHT1), anti-CD4-BV605 (RPA-T4), and anti-CD8-Alexa700 (SK1) for 30-45 minutes at room temperature. Cells were washed and incubated with pre-chilled (−20° C.) 90% methanol for 20-60 minutes. After methanol incubation, cells were washed again and stained with anti-CD25-BV421 (M-A251), anti-CD45RA-BV510 (HI100), anti-FoxP3-AF488 (249D), anti-CD56-PE, and anti-pSTAT5-Alexa647 (pY687) to mark various cell populations and STAT5 phosphorylation. Data depicting induction of STAT5 phosphorylation on CD8+ T cell, CD4+ T cell, Treg, and NK cell populations are depicted in FIG. 64. Consistent with the above data depicting Ki67 expression, the data here show that XENP26007 has significantly reduced potency in inducing STAT5 phosphorylation on CD8+ and CD4+ T cells as well as Tregs and NK cells in comparison to XENP20818, and targeting with anti-NKG2A or anti-NKG2D Fabs (as in XENP27145 and XENP27146) selectively targets NK cells while showing no preferred targeting of CD8+ T cells, CD4+ T cells, or Tregs.

Example 3: CD8-Targeted IL-15/Rα-Fc Fusion

3A: Engineering CD8-Targeted IL-15/Rα-Fc Fusions

The parental variable region of a murine anti-CD8 antibody (depicted in FIG. 65 as XENP15076) was humanized (as previously described in U.S. Pat. No. 7,657,380, issued Feb. 2, 2010) and engineered in the Fab format for use as component of prototype CD8-targeted IL-15/Rα-Fc fusion. The sequences for the humanized anti-CD8 is depicted in FIG. 65 as a bivalent antibody (XENP15251) and Fab (XENP23647), as well as a humanized variant as a one-arm mAb (XENP24317).

CD8-targeted IL-15/Rα-Fc fusions were generated in the scIL-15/Rα x Fab format as depicted in FIG. 57D, which comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH. Illustrative CD8-targeted IL-15/Rα-Fc fusions in this format include XENP24114, XENP24115, and XENP24116, sequences for which are depicted in FIG. 66.

CD8-targeted IL-15/Rα-Fc fusions were also generated in the following formats: the Fab x ncIL-15/Rα format as depicted in FIG. 57E, which comprises a VH fused to the N-terminus of a heterodimeric Fc-region, with IL-15Rα (sushi) fused to the other side of the heterodimeric Fc, while a corresponding light chain is transfected separately so as to form a Fab with the VH, and while IL-15 is transfected separately so that a non-covalent IL-15/Rα complex is formed; the mAb-scIL-15/Rα format as depicted in FIG. 57G, which comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form a Fabs with the VHs; the mAb-ncIL-15/Rα format as depicted in FIG. 57H, which comprises VH fused to the N-terminus of a first and a second heterodimeric Fc, with IL-15Rα (sushi) fused to the C-terminus of one of the heterodimeric Fc-region, while corresponding light chains are transfected separately so as to form a Fabs with the VHs, and while and while IL-15 is transfected separately so that a non-covalent IL-15/Rα complex is formed; the central-IL-15/Rα as depicted in FIG. 57J, which comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs; and the central-scIL-15/Rα format as depicted in FIG. 57K, which comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form a Fabs with the VHs. Illustrative sequences for CD8-targeted IL-15/Rα-Fc fusions of these alternative formats are depicted in FIG. 79.

Plasmids coding for the VH and VL sequences as described above, IL-15 and IL-15Rα(sushi) domains, light chain constant region, and heterodimeric constant regions (as depicted in FIG. 9) were constructed by Gibson assembly. Proteins were produced by transient transfection in HEK293E cells and were purified by a two-step purification process comprising Protein A chromatography followed by ion exchange chromatography.

3B: Induction of Cell Proliferation by a CD8-Targeted IL-15 Fc Fusion Prototype A bivalent anti-CD8 antibody (XENP15251), one-arm scIL-15/Rα-Fc fusion (XENP21993), CD8-targeted scIL-15/Rα-Fc (XENP24114) which has an anti-CD8 Fab arm based on XENP15251 were tested in a cell proliferation assay.

Human PBMCs were treated with the test articles at the indicated concentrations. 3 days after treatment, the PBMCs were stained with anti-CD3-PE (OKT3), anti-CD4-FITC (RPA-T4), anti-CD8-APC (RPA-T8), anti-CD16-BV605 (3G8), anti-CD45RA-APC/Fire750 (HI100) and anti-Ki67-PE/Cγ7 (Ki-67) and analyzed by FACS. Lymphocytes were first identified by gating on the basis of SSC and FSC. The lymphocytes were then gated based on CD3 expression to identify NK cells (CD3−CD16+) and CD3+ T cells. The CD3+ T cells were then gated based on CD4 and CD8 to identify CD4+, CD8+ and γδ T cells (CD3+CD4−CD8−). CD4+ and CD8+ memory T cell subpopulations were then identified by further gating based on CD45RA. Finally, percentage of Ki67, a protein strictly associated with cell proliferation, on CD4+ T cells (CD3+CD4+CD45RA−), CD8+ T cells (CD3+CD8+CD45RA−), and NK cells was determined (depicted respectively in FIGS. 67A-C). The data show that the CD8-targeted IL-15/Rα-Fc fusion was more potent at inducing CD8+ T cell proliferation than the one-armed IL-15/Rα-Fc fusion. Notably, the CD8-targeted IL-15/Rα-Fc fusion was less potent at inducing CD4+ T cell proliferation than the one-armed IL-15/Rα-Fc fusion, due to weakened IL-15 activity resulting from inclusion of a Fab arm.

3C: Induction of Cell Proliferation by a CD8-Targeted Reduced-Potency IL-15 Fc Fusion Prototype One-arm scIL-15/Rα Fc fusion (XENP21993), one-arm reduced potency scIL-15/Rα Fc fusion (XENP24014) and CD8-targeted reduced potency scIL-15/Rα-Fc fusions (XENP24116) which has an anti-CD8 Fab arm based on XENP15251 were tested in a cell proliferation assay. Human PBMCs were treated with the test articles at the indicated concentration. 3 days after treatment, the PBMCs were analyzed by FACS. Percentage of Ki67 on CD4+ T cells, CD8+ T cells, and NK cells are depicted in FIGS. 68A-68C.

The data show that in comparison to XENP21993, XENP24014 demonstrated decreased potency in proliferating NK cells, CD4+ T cells, and CD8+ T cells. In comparison to XENP24014, XENP24116 demonstrated increased potency in proliferating CD8+ T cells (comparable to XENP21993), reduced potency on CD4+ T cells, and similar potency on NK cells.

3D: Effect of CD8-Targeted Reduced-Potency IL-15 Fc Fusion Prototype on Tregs The effect of CD8-targeted reduced potency scIL-15 (N65D)/Rα-Fc (XENP24116), as well as one-arm reduced potency scIL-15(N65D)/Rα Fc fusion (XENP24014), reduced potency IL-15(Q108E)/Rα-Fc heterodimer (XENP22822) and recombinant human IL-15 (rhIL-15), on Treg proliferation (as indicated by percentage Ki67 expression on CD4+ T cells) was investigated.

In vitro rapamycin expanded Tregs were used to investigate the effect of CD8-targeted IL-15/Rα-Fc fusions. It has been previously reported that rapamycin promotes proliferation of CD4+CD25+FOXP3+T regs in vitro, and resulting expanded Tregs suppress CD4+ and CD8+ T cell proliferation (see, for example, Battaglia et al. (2006) Rapamycin promotes expansion of functional CD4+CD25+ FOXP3+ regulatory T cells of both healthy subjects and type 1 diabetic patients. J Immunol. 177(12) 8338-8347; and Strauss et al. (2007) Selective survival of naturally occurring human CD4+CD25+Foxp3+ regulatory T cells cultured with rapamycin. J Immunol. 178(1) 320-329). Accordingly, CD4+ T cells were enriched from human PBMCs from two donors (Donor 21 and 23) by negative selection using EasySep™ Human CD4+ T Cell Enrichment Kit (STEMCELL Technologies, Vancouver, Canada). Treg were expanded using Dynabeads™ Human Treg Expander (Thermo Fisher Scientific, Waltham, Mass.) in RPMI1640+ 10% fetal bovine serum+0.1 μg/ml rapamycin+500 U/ml IL-2 for 1-4 days. Tregs were transferred to T75 flasks coated with 0.5 μg/ml anti-CD3 (OKT3, Biolegend, San Diego, Calif.) and cultured with RPMI1640+10% fetal bovine serum+0.1 μg/ml rapamycin+100 U/ml IL-2+0.5 μg/ml anti-CD28 mAb. Experiments were performed at least 8 days after initial enrichment of CD4+ T cells from PBMCs. $1.5 \times 10^5$ rapamycin cultured Tregs were incubated with indicated concentration of the indicated test articles for 4 days on anti-CD3 coated plates (0.5 μg/mL OKT3) at 37° C. On day 4, cells were analyzed by FACS. Percentage of Ki67 on CD4+T are depicted in FIG. 69A-69B respectively for donors 21 and 23. CD4+ cell counts are depicted in FIG. 70A-B respectively for donors 21 and 23. CD25 MFI are depicted in FIGS. 71A-B respectively for donors 21 and 23.

The data show that recombinant human IL-15 induces the most robust Treg proliferation. While XENP22822 and XENP24014 induce less Treg proliferation compared to rhIL-15, the CD8-targeted reduced potency scIL-15(N65D)/ Rα-Fc fusion XENP24116 is the weakest inducer of Treg proliferation.

3E: Induction of CD8+ T Cell Proliferation by CD8-Targeted Reduced-Potency IL-15 Fc Fusion in a Suppression Assay The effect of CD8-targeted reduced potency scIL-15 (N61D)/Rα-Fc fusion (XENP24115), as well as one-arm reduced potency scIL-15(N61D)/Rα Fc fusion (XENP24013), on CD8+ responder T cell, CD4+ responder T cell, and NK cell proliferation in the presence of Tregs was investigated.

CFSE labeled PBMCs were incubated with 500 ng/mL of indicated test articles and indicated concentration of Tag-it Violet labeled Tregs (expanded as described in Example 2C) on anti-CD3 coated plates (OKT3; 100 ng/mL). After 4 days incubation at 37° C., cells were analyzed by FACS, and proliferation was measured by CFSE. The data is depicted in FIG. 72A-72C respectively for percentage proliferating CD8 T cell, CD4 T cell and NK cell. FIG. 73 depicts the Treg counts in a similar experiment using different Tregs:PBMC ratios.

The data show that the CD8-targeted IL-15/Rα-Fc fusions increases CD8+ responder T cell proliferation, and more Tregs were needed to suppress proliferation. The data also show that neither XENP24115 nor XENP24013 affected CD4+ responder T cell proliferation; however, both induced NK cell proliferation. Notably, FIG. 73 shows that while the CD8-targeted IL-15/Rα-Fc fusion still induces proliferation of Tregs (in comparison to control with no treatment), the induction is substantially less than that resulting from treatment with one-arm scIL-15/Rα-Fc.

In a further experiment, the dose response for proliferation of CD8+ memory T cell, CD4+ memory T cell and Tregs following treatment with CD8-targeted IL-15/Rα-Fc fusions in the presence of Tregs was investigated. 1×105 CFSE labeled PBMCs and 5×104 Tag-it Violet labeled Tregs (expanded as described in Example 3D; 1:2 Treg:PBMC ratio) were incubated with indicated concentrations of indicated test articles including anti-RSV bivalent mAb (XENP15074) as control for 4 days on anti-CD3 coated plates (OKT3; 100 ng/mL). Proliferation was measured by CFSE or Tag-it Violet dilution. The data is depicted in FIG. 74A-74C, respectively for CD8+ memory T cells, CD4+ memory T cells and Tregs. Finally, the dose response for proliferation of Tregs in the absence of PBMCs following treatment with CD8-targeted IL-15/Rα-Fc fusion was investigated. 1×105 Tag-it Violet labeled Tregs were incubated with indicated concentrations of indicated test articles for 4 days on anti-CD3 coated plages (OKT3; 100 ng/mL). Cell counts as depicted in FIG. 75 was measured by Tag-it Violet dilution.

The data show that the CD8-targeted IL-15/Rα-Fc fusion induced greater proliferation of CD8+ memory T cells than the one-arm scIL-15/Rα-Fc at all concentrations tested. Notably, the CD8-targeted IL-15/Rα-Fc fusion induces less proliferation of CD4+ memory T cells and Tregs than the one-arm scIL-15/Rα-Fc.

3F: Activity of a Prototype CD8-Targeted Reduced-Potency IL-15 Fc Fusion in a GVHD Model CD8-targeted reduced potency IL-15/Rα-Fc fusion (XENP24116) and additional reduced potency IL-15 variants were evaluated in a Graft-versus-Host Disease (GVHD) model conducted in female NSG (NOD-SCID-gamma) immunodeficient mice. When the NSG mice were injected with human PBMCs, the human PBMCs developed an autoimmune response against mouse cells. Treatment of NSG mice injected with human PBMCs followed with CD8-targeted IL-15/Rα-Fc fusion and IL-15 variants enhance proliferation of the engrafted T cells.

10 million human PBMCs were engrafted into NSG mice via IV-OSP on Day −7 followed by dosing with the indicated test articles (0.3 mg/kg) on Day 0. Whole blood was collected on Days 4 and 7, and mice were sacrificed on Day 11 for their spleens to measure CD4+ and CD8+ T cell counts using FACS. FIG. 76A-76D respectively depict CD4+ T cell events, CD8+ T cell events, correlation between CD8+ T cell and CD4+ T cell events and CD8+ T cell/CD4+ T cell ratio in whole blood on Day 4. FIG. 77A-77D respectively depict CD4+ T cell events, CD8 T cell events, correlation between CD8+ T cell and CD4+ T cell events and CD8+ T cell/CD4+ T cell ratio in whole blood on Day 7. FIG. 78A-78D respectively depict CD4+ T cell events, CD8 T cell events, correlation between CD8+ T cell and CD4+ T cell events and CD8+ T cell/CD4+ T cell ratio in spleen on Day 8. Each point represents one female NSG mouse. The data show that XENP24116 selectively expands CD8+ T cells in comparison to the IL-15 variants which expand both CD4+ and CD8+ T cells.

3G: Alternative Format CD8-Targeted IL-15 Fc Fusions

A number of alternative format CD8-targeted IL-15/Rα-Fc fusions as depicted in FIG. 57 (cartoon) and FIG. 79 (sequences) were tested in a cell proliferation assay. Human PBMCs were treated with XENP24114, XENP24116, XENP24546, XENP24543, XENP24547, and XENP24548. 3 days after treatment, the PBMCs were analyzed by FACS. Percentage of Ki67 on CD4+ T cells, CD8+ T cells, and NK cells are depicted in FIG. 80.

Example 4: CD8-Targeted IL-15/Rα-Fc Fusion (Non-Blocking CD8 Binding Domain)

4A: Phage Display Library and Screening of CD8 Binders

Recombinant human CD8α and cyno CD8α were generated in-house for phage panning. Plasmids coding for the antigens were constructed by Gibson assembly in a pTT5 vector. After transient transfection of HEK293E cells, the secreted antigens were purified via Protein A affinity chromatography.

In-house de novo phage libraries were built displaying Fab variants on phage coat protein pIII, and were panned in 4 rounds. Prior to the first round and after each round, phage were added to log-phase XL1-Blue cells (Agilent, Wilmington, Del.) and incubated overnight at 37° C., 250 rpm. Fab clones were sequenced for their VH and VL identity, from which plasmids were constructed by Gibson assembly and subcloned into a pTT5 expression vector containing the coding sequence for the IgG1 constant regions. DNA was transfected in HEK293E for expression and resulting bivalent mAbs were purified from the supernatant using protein A affinity chromatography. The amino acid sequence for exemplary clone 1C11B3 is depicted in FIG. 81 bivalent mAb (XENP24025) and one-arm mAb (XENP24321).

4B: Phage Display Library and Screening of CD8 Binders

Phage clone 1C11B3 reformatted as one-arm Fab-Fc antibody (respectively XENP24321) was tested for binding to CD4+ and CD8+ T cells. A one-arm Fab-Fc antibody (XENP24317; sequences depicted in FIG. 65) based on a variant of XENP15251 was used as control.

T cells purified from human PBMCs using EasySep™ Human T Cell Isolation Kit (STEMCELL Technologies, Vancouver, Canada) were incubated with the test articles at the indicated concentrations for 1 hour on ice. Cells were centrifuged to remove excess amounts of test articles, resuspended with anti-CD3-FITC (HIT3a), anti-CD4-PE (OKT4) and a secondary antibody conjugated with APC, and incubated for 45 minutes on ice. Cells were washed twice, resuspended with staining buffer and analyzed with FACS. FIG. 82 depicts the MFI on CD4+ and CD8+ T cells. The data showed that XENP24321 binding to CD8+ T cells was superior to that of XENP24317.

4B: Identifying an Anti-CD8 mAb that does not Block CD8 Interaction with pMHCI Tumor cells present major histocompatibility complex class I molecules (MHCI) which display peptide fragments recognized by the TCR (specific for the peptide) and CD8 on CD8+ T cells (as depicted in FIG. 83A). The binding of CD8 to pMHCI triggers proliferation and activation of the T cells. An anti-CD8 antibody may bind an epitope on CD8 which positions it so that it blocks binding of pMHCI by CD8 thereby preventing activation of the CD8+ T cell (FIG. 83B). In order to preserve activation, it is necessary to use an anti-CD8 arm in the CD8-targeted IL-15/Rα-Fc fusion which does not block the CD8-MHCI interaction.

4C(a): MHC Tetramer Assay

An MHC tetramer assay was used to investigate whether the anti-CD8 mAb clones described above blocked CD8 interaction with pMHCI. ~200 k T cells specific for HLA-A2*0201 restricted CMV pp65 (NLVPMVATV) peptide (SEQ ID NO: 6) (Donor153 from Astarte Biologics, Bothell, Wash.) were pre-incubated with indicated test articles at the indicated concentrations on ice for 30 minutes. A control sample incubated without anti-CD8 antibody was also used. Following incubation, the samples were stained with iTAg Tetramer/PE-HLA2:01 CMV pp65 (NLVPMVATV) (SEQ ID NO: 6) (MBL, Woburn, Mass.), anti-CD3-BUV395 (UCTH-1) and anti-CD4-APC/Fire750 (OKT4) for 1.5 hour and analyzed by FACS. The cells were first gated based on CD3 and CD4 expression to identify CD8+ cells. Binding of the MHC tetramer on the CD3+ cells was measured as PE MFI. The data is depicted in FIG. 84 as fraction of binding relative to the control sample.

The data show that pre-incubation with commercial OKT8 mAb (Thermo Fisher Scientific, Waltham, Mass. and in-housed produced as XENP15075) enabled MHC tetramer binding comparable to that of the control sample, while pre-incubation with other commercial mAbs SK-1 (BioLegend, San Diego, Calif.), 32-M4 (Santa Cruz Biotechnology, Dallas, Tex.) and DK25 (Dako, Carpinteria, Calif.) decreased binding by 15-80% which is consistent with results reported by Clement et al. Pre-incubation with XENP15251 decreased MHC tetramer binding by over 50%. Notably, pre-incubation with XENP24025 (1C11B3) decreased MHC tetramer binding by ~4% suggesting that clone 1C11B3 is non-blocking.

4C(b): Cytokine Release Assay

As described above, binding of TCR and CD8 on CD8+ T cells to pMHCI activates the T cell leading to cytokine release. Therefore, it was also investigated whether the anti-CD8 mAb clones blocked CD8 interaction with pMHCI in a cytokine release assay.

T2 cells were loaded with 50 ng/ml HLA-A2*0201 restricted CMV pp65 (NLVPMVATV) peptide (SEQ ID NO: 6) overnight at room temperature. As a negative control, T2 cells were loaded with NY-ESO-1 peptide. After overnight loading, the T2 cells were treated with Mitomycin-C(Sigma-Aldrich, St. Louis, Mo.) for 30 minutes at 37° C. 50 k T cells specific for HLA-A2*0201 restricted CMV pp65 (NLVPMVATV) peptide (SEQ ID NO: 6) were pre-incubated with 100 µg/ml of the indicated test articles (in duplicates). 10 k peptide loaded T2 cells were then added to the samples and incubated for 18 hours at 37° C. Controls without anti-CD8 pre-incubation were as follows: A) T2 cells loaded with pp65 peptide incubated with CMV specific T cells, B) T2 cells loaded with NY-ESO-1 peptide incubated with CMV specific T cells, C) unloaded T2 cells incubated with CMV specific T cells, and D) CMV specific T cells alone. Supernatant were collected and analyzed with IFNγ MSD assay (Meso Scale Discovery, Rockville, Md.).

The data as depicted in FIG. 85 show that IFNγ release by CMV specific T cells pre-incubated with OKT8 and XENP24025 was comparable to IFNγ release by CMV specific T cells in the absence of anti-CD8 antibody pre-incubation, while a decrease in IFNγ release was observed in CMV specific T cells pre-incubated with commercial antibodies SK-1, 32-M4 and DK25 as well as XENP15251. Furthermore, IFNγ release by CMV specific T cells pre-incubated with XENP24025 was comparable to release by CMV specific T cells in the absence of anti-CD8 antibody pre-incubation. FIG. 86 depicts the correlation between IFNγ release and tetramer binding MFI.

4D: CD8-Targeted IL-15/Rα-Fc with 1C11B3 Selectively Induces Proliferation of CD8+ T Cells Over CD4+ T Cells Human PBMCs were treated with XENP24736 (CD8-targeted reduced potency IL-15(N4D/N65D)/Rα-Fc with 1C11B3; sequences depicted in FIG. 87), XENP24050 (one-arm reduced potency IL-15(N4D/N65D)/Rα-Fc), XENP24321 (one-arm anti-CD8 mAb based on 1C11B3), and XENP20818 (WT IL-15/Rα-Fc) at the indicated concentrations for 3 days at 37° C. Next, the PBMCs were stained with anti-CD3-PE (OKT3), anti-CD4-FITC (RPA-T4), anti-CD8α-BV510 (RPAT8 or SK1), anti-CD8β-eF660 (SIDI8BEE), anti-CD16-BV421 (3G8), anti-CD25-PerCP/Cy5.5 (M-A251), anti-CD45RA– APC/Fire750 (HI100), and anti-CD56-BV605 (5.1H1) for 45 minutes on ice. Following staining with the afore panel, cells were stained with anti-Ki67-PE/Cy7 (Ki-67) for 30 minutes at room temperature and analyzed by FACS for various cell populations and their expression of Ki67. Data depicting percentage of CD8+CD45RA– and CD4+CD45RA– T cells expressing Ki67 are depicted in FIG. 88. The data show that in comparison to one-arm reduced-potency IL15/Rα-Fc XENP24050, CD8-targeting with 1C11B3 enhances proliferation of CD8+ T cells.

Example 5: CD8-Targeted IL-15 Fc Fusion (OKT8-Based)

5A: Humanization of OKT8

Prior art anti-CD8 antibody OKT8 (variable region sequence depicted in FIG. 89 as OKT8_H0.1 and OKT8_L0.1) was engineered in the context of a Fab for use in CD8-targeting IL-15 molecules. OKT8 was humanized using string content optimization (see, e.g., U.S. Pat. No. 7,657,380, issued Feb. 2, 2010). Variable heavy and light chain sequences for illustrative humanized OKT8 clones are depicted in FIG. 89. As above, CD8-targeted IL-15/Rα-Fc fusions were produced using Gibson-constructed plasmids coding for the VH and VL sequences as described above along with coding sequence for heterodimeric constant regions (as depicted in FIG. 9). Proteins were produced by transient transfection in HEK293E cells and were purified by a two-step purification process comprising Protein A chromatography followed by ion exchange chromatography. Sequences for illustrative CD8-targeted IL-15/Rα-Fc fusions with anti-CD8 Fab arms based on murine or humanized OKT8 variable regions are depicted in FIG. 92.

5A(a): OKT-8 Based CD8-Targeted IL-15/Rα-Fc Fusions Selectively Proliferate CD8⁺ T Cells Over CD4⁺ T Cells Human PBMCs were treated with CD8-targeted reduced-potency IL-15/Rα-Fc (N4D/N65D double mutant and D30N/E64Q/N65D triple mutant) with CD8 binding domains based on murine OKT8 or two versions of humanized OKT8 (H1L1 and H2L1) at the indicated concentrations for 3 days at 37° C. Following treatment, the PBMCs were stained with anti-CD3-PE (OKT3), anti-CD4-FITC (RPA-T4), anti-CD8α-BV510 (RPAT8 or SK1), anti-CD8β-eF660 (SIDI8BEE), anti-CD16-BV421 (3G8), anti-CD25-PerCP/Cγ5.5 (M-A251), anti-CD45RA-APC/Cγ7 (HI100), and anti-CD56-BV605 (NCAM16.2) for 45 minutes on ice. Following staining with the panel, cells were stained with anti-Ki67-PE/Cγ7 (Ki-67) for 30 minutes at room temperature and analyzed by FACS for various cell populations and their expression of Ki67. Data depicting percentage of CD8+CD45RA− and CD4+CD45RA− T cells expressing Ki67 are depicted in FIG. 93. The data show that each of the CD8-targeted IL-15/Rα-Fc fusions were selective for CD8+ T cells over CD4+ T cells in comparison to control XENP20818. Unexpectedly, XENP24917 (OKT8_H1L1) was less potent in inducing proliferation of CD8+ T cells in comparison to XENP24919 (murine OKT8). Notably, XENP24918 (which had alternate humanized OKT8_H2L1) had restored potency similar to that of XENP24917. In addition, while XENP25137 which had reduced potency IL-15/Rα-Fc with triple mutant and OKT_H2L1 anti-CD8 Fab arm was more potent than XENP24918 in induction of CD8+ T cell proliferation, XENP25137 was also more potent than XENP24918 in induction of CD4+ T cell proliferation.

5A(b): OKT8-Based CD8-Targeted IL-15/Rα-Fc Fusion Proliferates T Cells and Enhances Cytokine Secretion In Vivo in PBMC-Engrafted NSG Mice 10 million human PBMCs were engrafted into NSG mice via IV-OSP on Day −8 followed by dosing with the indicated test articles at the indicated concentrations on Day 0. FIG. 94A-B respectively depict CD8+ and CD4+ T cell counts on Day 7. The data show that the CD8-targeted IL-15/Rα-Fc fusion selectively proliferates CD8+ T cells over CD4+ T cells, as indicated by the CD8+/CD4+ T cell ratio. Notably, the data show that the CD8+ T cell selectivity is due to targeting of the IL-15/Rα-Fc fusion rather than a combination of effect from IL-15/Rα-Fc fusion and anti-CD8 (as indicated by the combination of XENP24050 and XENP24920).

5B: Engineering OKT8 for Cynomolgus CD8 Affinity

For ease of clinical development, it is useful to assess various parameters of the CD8-targeted IL-15/Rα-Fc fusion proteins such as pharmacodynamics, pharmacokinetics, and toxicity in cynomolgus monkeys. However, one exemplary humanized OKT8 variant (H2L1) only had 200 nM KD affinity for cynomolgus CD8 in comparison to 12 nM KD affinity for human CD8. Accordingly, a library of variants based on OKT8_H2L1 (referred to hereon as HuCy OKT8) were engineered to have similar affinity to both human and cyno CD8. The library was constructed by site-directed mutagenesis (QuikChange, Stratagene, Cedar Creek, Tx.) or standard gene synthesis. Sequences for variant heavy variable regions and variant light variable regions are depicted in FIG. 95. One-arm mAbs based on the variant variable regions were generated with a heavy variable region attached to a heterodimeric Fc region and with the other side of the molecule being "Fc-only", and a light variable region attached to a constant light region. Illustrative sequences for such one-arm mAbs are depicted in FIG. 91.

Affinity of the one-arm mAbs based on HuCy OKT8 variants for human and cynomolgus CD8 were assessed on Octet, a BioLayer Interferometry (BLI)-based method. Experimental steps for Octet generally included the following: Immobilization (capture of ligand to a biosensor); Association (dipping of ligand-coated biosensors into wells containing serial dilutions of the analyte); and Dissociation (returning of biosensors to well containing buffer) in order to determine the affinity of the test articles. A reference well containing buffer alone was also included in the method for background correction during data processing. In particular, human or cynomolgus CD8 was captured and dipped in multiple concentrations of the OKT8 variants. The resulting dissociation constant ($K_D$), association rate ($k_a$), and dissociation rate ($k_d$) are depicted in FIG. 96. The data show that while a number of variants had improved affinity for cynomolgus CD8 in comparison to OKT_H2L1, only several of the variants had similar affinity for both human and cynomolgus CD8.

5C: CD8-Targeted IL-15/Rα-Fc Fusions (HuCy OKT8) are Active in Proliferation of Human T Cells CD8-targeted IL-15/Rα-Fc fusions with anti-CD8 Fab arms based on HuCy OKT8 variable regions were produced as generally described in Example 5A, sequences for illustrative molecules are depicted in FIG. 97 and FIG. 102.

5C(a): CD8-Targeted IL-15/Rα-Fc Fusions with HuCy OKT8 are Active In Vitro

Human PBMCs were treated with CD8-targeted reduced potency IL-15/Rα-Fc with illustrative HuCy OKT8 binding domains and one-arm reduced potency IL-15/Rα-Fc XENP24050 (as control) at the indicated concentrations for 3 days at 37° C. Following treatment, the PBMCs were stained with anti-CD3-PE (OKT3), anti-CD4-FITC (RPA-T4), anti-CD8α-BV510 (SK1), anti-CD8β-PE/Cγ7 (SIDI8BEE), anti-CD16-BV421 (3G8), anti-CD25-PerCP/Cγ5.5 (M-A251), anti-CD45RA-APC/Cγ7 (HI100), and anti-CD56-BV605 (NCAM16.2) for 45 minutes on ice. Following staining with the panel, cells were stained with anti-Ki67-PE/Cγ7 (Ki-67) for 30 minutes at room temperature and analyzed by FACS for various cell populations and their expression of Ki67. Data depicting percentage of CD8+CD45RA− and CD4+CD45RA− T cells expressing Ki67 are depicted in FIG. 98. The data show that each of the CD8-targeted molecules (including those with HuCy OKT8 binding domains) were more potent at inducing proliferation of CD8+ T cells than XENP24050.

In another experiment, fresh PBMCs were incubated with the indicated test articles at the indicated concentrations for 15 minutes. Following incubation, PBMCs were stained with anti-CD3-BUV395 (UCHT1), anti-CD4-BV605 (RPA-T4), and anti-CD8-Alexa700 (SK1) for 30-45 minutes at room temperature. Cells were washed and incubated with pre-chilled (−20° C.) 90% methanol for 20-60 minutes. After methanol incubation, cells were washed again and stained with anti-CD25-BV421 (M-A251), anti-CD45RA-BV510 (HI100), anti-FOXP3-Alexa488 (259D), anti-CD56-PE, and anti-pSTAT5-Alexa647 (pY694) at room temperature for 1 hour to mark various cell populations and STAT5 phosphorylation. Lymphocytes were first gated on the basis of side scatter (SSC) and forward scatter (FSC). CD4+ T cells were then gated based on CD3 and CD4 expression. Subpopulations of CD4+ T cells were further gated based on CD45RA expression, as well as FoxP3 and CD25 expression for Tregs. CD8+ T cells were gated based on CD3 and CD8 expression, and subpopulations were further gated based on CD45RA expression. Data depicting STAT5 phosphorylation on CD8+CD45RA− and CD4+CD45RA− T cells are shown in FIG. 99. Consistent with the data above depicting percentage of cells expressing Ki67, the HuCy OKT8-based CD8-targeted IL-15/Rα-Fc fusions are selective for CD8+ T cells over CD4+ T cells.

5C(b): CD8-Targeted IL-15/Rα-Fc Fusions (HuCy OKT8) Selectively Expand CD8+ T Cells In Vivo in PBMC Engrafted NSG Mice 10 million human PBMCs were engrafted into NSG mice via IV-OSP on Day −8 followed by dosing with the indicated test articles at the indicated concentrations on Day 0. FIG. 100 depicts the CD45+ cell, CD8+ T cell, and CD4+ T cell counts (as well as CD8+/CD4+ T cell ratio) in mice blood on Day 7. The data show that CD8-targeted IL-15/Rα-Fc fusions with HuCy OKT8 had similar activity in expanding CD45+ cells and T cells as CD8-targeted IL-15/Rα-Fc with OKT8_H2L1. Importantly, the CD8-targeted IL-15/Rα-Fc fusions with HuCy OKT8 retained selective expansion of CD8+ T cells over CD4+ T cells.

5D: OKT8-Based CD8-Targeted IL-15/Rα-Fc Fusions are Active in Proliferation of Cynomolgus T Cells Next, it was investigated whether the above CD8-targeted IL-15/Rα-Fc fusion with HuCy OKT8 binding domains were able to proliferate cynomolgus monkey lymphocytes. Cyno PBMCs were incubated with the indicated test articles for 4 days. Following incubation, PBMCs were stained with anti-CD3-PE (OKT3), anti-CD4-FITC (RPA-T4), anti-CD8α-BV510 (SK1), anti-CD8β-PE/Cy7 (SIDI8BEE), anti-CD16-BV421 (3G8), anti-CD25-PerCP/Cy5.5 (M-A251), anti-CD45RA-APC/Cy7 (HI100), and anti-CD56− BV605 (NCAM16.2) for 45 minutes on ice. Following staining with the panel, cells were stained with anti-Ki67-APC (Ki-67) for 30 minutes at room temperature and analyzed by FACS for various cell populations and their expression of Ki67. Data depicting percentage of CD8+CD45RA− and CD4+CD45RA− T cells expressing Ki67 are depicted in FIG. 101. The data show that each of the CD8-targeted IL-15/Rα-Fc fusions was able to proliferate cynomolgus T cells. Consistent with the data depicted in Example 5A(a), the CD8-targeted molecules were selective for CD8+ T cells over CD4+ T cells.

Example 6: CD8-Targeted IL-15/Rα-Fc Fusions are Selective for CD8+ T Cells Over CD4+ T Cells and Tregs

6A: CD8-Targeted IL-15/Rα-Fc Fusions Selectively Expand CD8+ T Cells Over CD4+ T Cells and Tregs In Vitro Human PBMCs were incubated with indicated test articles for 2, 5, 10, 15, 30, 60, 180, and 360 minutes at 37° C. The timing was achieved by adding the test articles at different times so that all the reactions were stopped simultaneously. Following incubation, PBMCs were stained with anti-CD3-BUV395 (UCHT1), anti-CD4-BV605 (RPA-T4), and anti-CD8-Alexa700 (SK1) for 30-45 minutes at room temperature. Cells were washed and incubated with pre-chilled (−20° C.) 90% methanol for 20-60 minutes. After methanol incubation, cells were washed again and stained with anti-CD25-BV510 (M-A251), anti-CD45RA-BV510 (HI100), anti-FOXP3-Alexa488 (259D), and anti-pSTAT5-Alexa647 to mark various cell populations and STAT5 phosphorylation. Lymphocytes were first gated on the basis of side scatter (SSC) and forward scatter (FSC). CD4+ T cells were then gated based on CD3 and CD4 expression. Subpopulations of CD4+ T cells were further gated based on CD45RA expression, as well as FoxP3 and CD25 expression for Tregs. CD8+ T cells were gated based on CD3 and CD8 expression, and subpopulations were further gated based on CD45RA expression. Data depicting STAT5 phosphorylation on the various populations are depicted in FIG. 103. The data show that CD8-targeted IL-15/Rα-Fc fusions activated CD8+ T cells while avoiding CD4+ T cells, including Tregs, demonstrating that the CD8-targeted molecules were selective for CD8+ T cells in comparison to WT IL-15 as well as IL-15/Rα-Fc fusions. Notably, much higher concentrations of the CD8-targeted IL-15/Rα-Fc (XENP26585) stimulated baseline levels of STAT5 phosphorylation in CD4+ T cells and Tregs in comparison to recombinant IL-15 and WT IL-15/Rα-Fc fusions XENP20818.

6B: CD8-Targeted IL-15/Rα-Fc Fusions Selectively Expand CD8+ T Cells Over CD4+ T Cells in Cynomolgus Monkeys Next, the in vivo effect of the CD8-targeted IL-15/Rα-Fc fusions was investigated in expanding T cells in cynomolgus monkeys. Cynomolgus (3 animals per group) were dosed with the indicated test articles on Day 0 and monitored for 3 weeks. Data depicting fold change in CD8+ T cell and CD4+ T cell are depicted in FIG. 104. Data depicting the percentage of CD4+CD45RA− and CD8+CD45RA− T cells in peripheral blood positive for Ki67 expression are depicted in FIG. 105. Data depicting the percentage of Ki67 on CD8+CD45RA− T cells in lymph nodes are depicted in FIG. 106. Consistent with in vitro data on expansion of cynomolgus PBMCs as depicted in Example 5D as well as in vivo data on expansion of human PBMCs in PBMC-engrafted mice, the data here show that the CD8-targeted IL-15/Rα-Fc fusions selectively expand CD8+ T cells over CD4+ T cells

Example 7: CD8-Targeted IL-15/Rα-Fc Fusions Demonstrate Enhanced Pharmacodynamics In a follow-on study in cynomolgus monkeys, one-arm scIL-15(N4D/N65D)/Rα-Fc with Xtend (XENP24294; sequences depicted in FIG. 40) and CD8-targeted IL-15 (N4D/N65D)/Rα-Fc with Xtend (XENP26585; sequences depicted in FIG. 102) were investigated. Cynomolgus (3 per group) were dosed with the test articles on Days 1 and 16, and blood was drawn over time to investigate T cell expansion. Data depicting CD8+ T cell and CD4+ T cell counts, as well as CD8+/CD4+ T cell ratio, are depicted in FIG. 107. Consistent with the study depicted in Example 6B, the CD8-targeted IL-15/Rα-Fc fusion selectively expanded CD8+ T cells over CD4+ T cells, enabling an enhanced CD8+/CD4+ T cell ratio. Notably, the CD8-targeted IL-15/

Rα-Fc fusion had improved pharmacodynamics over the one-arm molecule as indicated by the longer duration of CD8+ T cell expansion.

Example 8: CD8-Targeted IL-15 Fc Fusions Enhances Allogeneic Anti-Tumor Activity of CD8+ T Cells (In Vitro)

T cells were purified from human PBMCs (CMV+HLA-A0201) using EasySep™ Human T Cell Enrichment Kit (STEMCELL Technologies, Vancouver, Canada) according to the manufacturer's instructions. Purified T cells were incubated with CFSE-labeled parental MCF-7 tumor cells (designated in this Example as Group 1) or CFSE-labeled pp65-expressing MCF-7 tumor cells (designated in this Example as Group 1) at a 19:1 E:T ratio and the indicated test articles for 4 days. At Day 3, Brefeldin A (BioLegend, San Diego, Calif.) and anti-CD107a-PerCP/Cy5.5 (LAMP-1) were added to the cells. Following incubation, cells were incubated with Zombie Aqua™ Fixable Viability Kit (BioLegend, San Diego, Calif.) for 30 minutes at room temperature. Cells were washed and stained with anti-CD4-APC/eFluor780 (RPA-T4), anti-CD8b-PE/Cy7 (SIDI8BEE), anti-CD25-PE (M-A251), and anti-CD69-BV605 (FN50) for 1 hour on ice. Cells were washed again and stained with anti-IFNγ-BV421 (4S.B3) and anti-Ki67-APC using eBioscience™ Foxp3/Transcription Factor Staining Buffer Set (Thermo Fisher Scientific, Waltham, Mass.). Cells were analyzed by flow cytometry for various cell populations. Target cells were identified based on CFSE staining, and dead target cells were identified based on Zombie staining. Effector cells (CFSE−) were gated based on CD4 and CD8 expression.

Ki67 is a protein strictly associated with protein proliferation, while production of IFNγ by T cells indicates cytolytic activity. FIGS. 108A-108B respectively depict IFNγ+ fractions in CD8+ T cells in the two groups. FIGS. 109A-109B respectively depict Ki-67+ fractions of CD8+ T cells in the two groups. FIGS. 110A-110B respectively depict Ki-67+/IFNγ+ fractions of CD8+ T cells in the two groups. FIGS. 111A-111B respectively depict IFNγ+ fractions in CD4+ T cells in the two groups. FIGS. 112A-112B respectively depict Ki-67+ fractions of CD4+ T cells in the two groups. FIGS. 113A-113B respectively depict Ki-67+/IFNγ+ fractions of CD4+ T cells in the two groups. FIGS. 114A-114B respectively depict remaining target cells (either pp65-transduced MCF-7 or parental MCF-7) in the two groups. Overall, the data show that the CD8-targeted IL-15/Rα-Fc fusions of the invention not only enhance allogeneic killing of tumor cells, but also that the CD8-targeted IL-15/Rα-Fc fusions selectively expand CD8+ T cells over CD4+ T cells.

Example 9: CD8-Targeted IL-15/Rα-Fc Fusions Enhance Allogeneic Anti-Tumor Effect of T Cells In Vivo and Combine Synergistically with Checkpoint Blockade Next, the in vivo anti-tumor effect of the CD8-targeted IL-15/Rα-Fc fusion proteins of the invention was investigated, as well as whether they were suitable for stacking with checkpoint blockade. Checkpoint blockade antibody used was XENP16432 (a bivalent anti-PD-1 mAb based on nivolumab with ablated effector function; sequence depicted in FIG. 12). NOD SCID gamma (NSG) mice (10 per group) were engrafted intradermally with 3×106 pp65-expressing MCF-7 cells in the rear flank on Day −14. On Day 0, mice were engrafted intraperitoneally with 5×106 human PBMCs from an HLA matched CMV+ donor that screened positive for T cell pp65 reactivity (or PBS for control mice). Mice were treated weekly with the indicated test articles or PBS (for control mice) for 4 weeks (4 total doses). Tumor volumes were monitored by caliper measurements, data for which are shown (days post 1st dose) in FIGS. 115A-115B. Blood was drawn on Day 7, 12, 19, and 26 and analyzed by flow cytometry to count various lymphocyte populations as depicted in FIGS. 116A-116E.

Example 10: Phage-Derived NKG2D Antigen Binding Domains

Here, we describe the generation and characterization of phage-derived NKG2D ABD (referred to as 1D7B4) used in the NKG2D-targeted IL-15/Rα-Fc fusions of the invention. The variable heavy and variable light domain sequences of 1D7B4 are depicted in FIG. 117A-FIG. 117C, and sequences for a bivalent mAb (IgG1 with E233P/L234V/L235A/G236del/S67K ablation variants) based on 1D7B4 are depicted in FIG. 118 as XENP27055.

10A: Phage Display Library and Screening of NKG2D Antigen Binding Domains

Recombinant human NKG2D (XENP25379; sequences depicted in FIG. 119) and cynomolgus NKG2D (XENP25380; sequences depicted in FIG. 119) were generated in-house for phage panning. Plasmids coding for the antigens were constructed by Gibson assembly in a pTT5 vector. After transient transfection of HEK293E cells, the secreted antigens were purified via Protein A affinity chromatography.

In-house de novo phage libraries were built displaying Fab and scFv variants (respectively referred to hereon as "Fab library" and "scFv library") on phage coat protein pIII. Both the Fab library and the scFv library were panned in five rounds as follows: 1) human NKG2D, 2) cynomolgus NKG2D, 3) human NKG2D, 4) cynomolgus NKG2D, and 5) human NKG2D with increasing levels of stringency (both in terms of antigen concentration as well as wash stringency). After each round, eluted phage were added to log-phase XL1-Blue cells (Agilent, Wilmington, Del.) and amplified overnight at 37° C., 250 rpm.

192 clones were sequenced from each of the panning rounds 3, 4, and 5 from both the Fab library and the scFv library resulting in 1,152 clones. We then ranked human and cynomolgus NKG2D binding by these clones using an enzyme-linked immunosorbent assay (ELISA), generally described as follows. ELISA plates were first coated neutravidin and blocked with bovine serum albumin. Next, plates were coated with XENP25379, XENP25380, or XENP22490 (IgG1 Fc; sequences for which are depicted in FIG. 119) for 30 minutes at room temperature. Plates were then incubated with biotin for 10 minutes at room temperature. Diluted phage supernatant was added to plates and incubated for 1 hour at room temperature. Plates were washed and incubated with HRP-conjugated anti-M13 antibody for 30 minutes. Finally, TMB substrate was added for 5 minutes, reaction was quenched, and plates were read at 450 nm on SpectraMax (Molecular Devices, San Jose, Calif.). FIG. 120 depict illustrative ELISA results for 12 clones from the fourth panning round of the Fab library showing a range of relative binding to human and cynomolgus NKG2D.

Plasmids containing the variable heavy and variable light domains of the selected clones ranking high for binding to human and cynomolgus NKG2D (as determined by ELISA) were constructed by Gibson assembly and subcloned into a pTT5 expression vector containing the coding sequence for the IgG1 constant regions (with E233P/L234V/L235A/G236del/S67K ablation variants). DNA was transfected in HEK293E for expression and resulting bivalent mAbs were purified from the supernatant using protein A chromatography.

Next, we investigated the binding of the bivalent mAbs to cell-surface NKG2D using NKG2D-transfected T-Rex™-293 cells (hereon referred to as TREX293-NKG2D cells). TREX293-NKG2D cells were incubated with indicated concentrations of XENP27055 and other phage-derived anti-NKG2D mAbs, as well as control commercial APC-conjugated anti-NKG2D mAb (Biolegend, San Diego, Calif.) for 1 hour at 4° C. Cells were then stained with Alexa Fluor® 647 AffiniPure F(ab')$_2$ Fragment Goat Anti-Human IgG, Fcγ fragment specific secondary antibody (Jackson ImmunoResearch, West Grove, Pa.) for 1 hour at 4° C. and analyzed by flow cytometry. Data illustrating binding for XENP27055 and 4 additional phage-derived mAbs are depicted in FIG. 121, and show that each of the phage-derived mAbs were able to bind to TREX293-NKG2D cells with varying potencies.

10B: NKG2D-Targeted IL-15/Rα-Fc Fusions Based on Phage-Derived ABDs

NKG2D-targeted IL-15/Rα-Fc fusions based on the phage-derived NKG2D ABDs and comprising IL-15(N4D/N65D) variant were engineered and produced as generally described in Example 2A, illustrative sequences for which are depicted in FIG. 122 as XENP27197.

We first confirmed the binding of the NKG2D-targeted IL-15/Rα-Fc fusions to NKG2D using Octet, as generally described above. In particular, HIS 1K biosensors were used to capture HIS-tagged human NKG2D or HIS-tagged cynomolgus NKG2D and dipped into multiple concentrations of the NKG2D-targeted IL-15/Rα-Fc fusions. Kinetic analyses were performed by global fitting of binding data with a 1:1 Langmuir binding model. The resulting dissociation constant ($K_D$), association rate ($k_a$), and dissociation rate ($k_d$) are depicted in FIG. 123 for XENP27197 (NKG2D-targeted IL-15/Rα-Fc fusion based on 1D7B4 and IL-15(N4D/N65D) variant) and 4 additional NKG2D-targeted IL-15(N4D/N65D)/Rα-Fc fusions based on phage-derived NKG2D ABDs.

Next, we investigated the induction of STAT5 phosphorylation on NK cells. For this experiment, both fresh and activated PBMCs were used. Activated PBMCs, used as surrogates for activated lymphocytes in the tumor environment, were prepared by stimulating fresh PBMCs with 100 ng/mL plate-bound anti-CD3 (OKT3) for 2 days. Fresh and activated PBMCs were incubated with the following test articles at the indicated concentrations for 15 minutes at 37° C.: XENP20818 (untargeted IL-15/Rα-Fc), XENP27055 (NKG2D-targeted IL-15/Rα-Fc fusion based on 1D7B4 and having IL-15(N4D/N65D) variant), 4 additional NKG2D-targeted IL-15/Rα-Fc based on phage-derived NKG2D ABDs and IL-15(N4D/N65D) variant, as well as XENP27145 and XENP27195 (additional NKG2D-targeted IL-15/Rα-Fc fusions based on prior art NKG2D ABDs). To gate for various cell populations following incubation, PBMCs were stained with anti-CD3-BUV395 (UCHT1), anti-CD4-BV605 (RPA-T4), and anti-CD8-Alexa700 (SK1) for 30-45 minutes at room temperature. Cells were washed and incubated with pre-chilled (−20° C.) 90% methanol for 20-60 minutes. After methanol incubation, cells were washed again and stained with anti-CD25-BV421 (M-A251), anti-CD45RA-BV510 (HI100), and anti-pSTAT5-Alexa647 (pY687) to mark various cell populations and STAT5 phosphorylation. Data depicting induction of STAT5 phosphorylation on CD56 NK cell population are depicted in FIG. 124. Notably, the data show that the NKG2D-targeted fusion proteins selectively induced STAT5 phosphorylation on NK cells from activated PBMCs. This suggests that, in a clinical setting, the NKG2D-targeted IL-15/Rα-Fc fusions will be selective for activated tumor-infiltrating lymphocytes in the tumor environment. Additionally, it appears that the potency of STAT5 induction by the NKG2D-targeted IL-15/Rα-Fc fusions tracks with the affinity of the anti-NKG2D arm (as depicted in FIG. 123).

Example 11: Additional Anti-NKG2D Antigen Binding Domains

Additional anti-NKG2D binding domains contemplated for use herein are depicted in FIG. 117A-FIG. 117C (as variable heavy and variable light domains) and FIG. 125 (in bivalent IgG1 format with E233P/L234V/L235A/G236_/S267K ablation variants).

Additionally, we humanized murine anti-NKG2D binding domains using string content optimization (see, e.g., U.S. Pat. No. 7,657,380, issued Feb. 2, 2010), sequences for which are depicted in FIG. 117A-FIG. 117C (as variable heavy and variable light domains, with clone designations mAb A, mAb B, and mAb C) and FIG. 126 (in bivalent IgG1 format with E233P/L234V/L235A/G236_/S267K ablation variants).

Affinity screens of the additional anti-NKG2D ABDs as bivalent mAbs were performed on Octet as generally described above. In particular, HIS 1K biosensors were used to capture His-tagged human NKG2D and dipped into 100 nM of each bivalent mAb. Data depicting dissociation constant ($K_D$), association rate ($k_a$), and dissociation rate ($k_d$) are shown in FIG. 127.

NKG2D-targeted IL-15/Rα-Fc fusions based on the above-described NKG2D ABDs and comprising IL-15 (N4D/N65D) variant were engineered and produced as generally described in Example 2A, illustrative sequences for which are depicted in FIG. 122.

Example 12: IL-15-Fc Fusions Comprising IL-15(N4D/N65D) Variant Demonstrate Reduced Pharmacokinetics In a study investigating the pharmacokinetics of IL-15-Fc potency variants with Xtend, cynomolgus monkeys were administered a first single intravenous (i.v.) dose of XENP22853 (WT IL-15/Rα-heteroFc with Xtend), XENP24306 (IL-15(D30N/E64Q/N65D)/Rα-heteroFc with Xtend), XENP24113 (IL-15(N4D/N65D)/Rα-heteroFc with Xtend), and XENP24294 (scIL-15(N4D/N65D)/Rα-Fc with Xtend) at varying concentrations.

FIG. 134 depicts the serum concentration of the test articles over time following the first dose. As expected, incorporating potency variants in addition to Xtend substitution (as in XENP24306 and XENP24113) greatly improves the pharmacokinetics of IL-15-Fc fusions (in comparison to XENP22583). Unexpectedly, however, IL-15/Rα-heteroFc fusion XENP24113 and scIL-15/Rα-Fc fusion XENP24294 (which have the same IL-15(N4D/

N65D) potency variant) demonstrated reduced pharmacokinetics in comparison to XENP24306. This suggests that the reduced pharmacokinetics was due to the particular IL-15 potency variant rather than the format of the IL-15-Fc fusion. While a decrease in pharmacokinetics for XENP24113 and XENP24294 was expected on the basis of previous findings which demonstrated that the IL-15-Fc fusions having IL-15(N4D/N65D) variant had greater in vitro potency than IL-15-Fc fusions having the IL-15(D30N/E64Q/N65D) variant, the decrease in pharmacokinetics was unexpectedly disproportionate to the increase in potency. Accordingly, we sought to identify alternative IL-15 potency variants for use in the NKG2D-targeted IL-15-Fc fusions of the invention.

12B: Engineering Further Reduced Potency IL-15 Variants Comprising Modifications at the IL-15:CD132 Interface We noted that IL-15(N4D/N65D) has both its substitutions at the IL-15 interface responsible for binding to CD122, while IL-15(D30N/E64Q/N65D) has two substitutions (E64Q and N65D) at IL-15:CD122 interface; and one substitution (D30N) at the IL-15 interface responsible for binding to CD132. Accordingly, we reasoned that the modification at the IL-15:CD132 interface may contribute to the enhanced pharmacokinetics observed for XENP24306.

In view of the foregoing, we generated an additional library of IL-15 potency variants incorporating the D30N substitution. Sequences for illustrative such IL-15 variants are depicted in FIG. 135 and illustrative scIL-15/Rα-Fc fusions comprising these variants (sequences for which are depicted in FIG. 136) were produced and investigated in a cell proliferation assay.

Human PBMCs were incubated with the indicated test articles at the indicated concentrations for 3 days. Following incubation, the PBMCs were stained with anti-CD3-PE (OKT3), anti-CD4-FITC (RPA-T4), anti-CD8-eF660 (SIDI8BEE), anti-CD16-BV421 (3G8), anti-CD45RA-APC/Fire750 (HI100), anti-CD56-BV605 (5.1H11), and anti-Ki67-PE/Cγ7 (Ki-67) and analyzed by flow cytometry. FIG. 137 depicts the percentage of various lymphocyte populations expressing Ki67 indicative of proliferation.

The data show that scIL-15/Rα-Fc fusions comprising IL-15(D30N/E64Q/N65D) variant had drastically reduced activity in proliferation of various lymphocyte populations, in comparison both to an IL-15/Rα-heteroFc comprising the same IL-15 variant as well as to scIL-15/Rα-Fc fusions comprising the IL-15(N4D/N65D) variant. However, many of the scIL-15/Rα-Fc fusions having IL-15 variants comprising D30N substitution showed activity similar to that of WT scIL-15/Rα-Fc XENP21993. Notably, we identified a particular IL-15(D30N/N65D) variant which not only comprises the IL-15:CD132 interface modification, but also potency similar to that of the IL-15(N4D/N65D) variant (in the context of scIL-15/Rα-Fc fusion).

Sequences for illustrative NKG2D-targeted IL-15/Rα-Fc fusions comprising IL-15(D30N/N65D) variant are depicted in FIG. 138. Additionally, we constructed XENP29481, a RSV-targeted IL-15/Rα-Fc fusion comprising IL-15(D30N/N65D) variant (sequences for which are depicted in FIG. 140.

12C: NKG2D-Targeted IL-15-Fc Fusions Comprising IL-15(D30N/E64Q/N65D)

In view of the data depicted in Example 10B, it is expected that the NKG2D-targeted IL-15/Rα-Fc fusions will be selective for lymphocytes in the tumor environment; however, the cytokine moiety is still capable of signaling before reaching the tumor site and may contribute to systemic toxicity. Accordingly, we sought to further reduce the IL-15 potency by constructing NKG2D-targeted IL-15/Rα-Fc fusions with IL-15(D30N/E64Q/N65D) variant, which as described in Example 12B has drastically reduced activity. Sequences for illustrative NKG2D-targeted IL-15/Rα-Fc fusions comprising IL-15(D30N/E64Q/N65D) variant are depicted in FIG. 139. Additionally, we constructed XENP30432, a RSV-targeted IL-15/Rα-Fc fusion comprising IL-15(D30N/E64Q/N65D) variant (sequences for which are depicted in FIG. 140) to act as a surrogate for investigating the behavior of ICOS-targeted IL-15/Rα-Fc fusions comprising IL-15(D30N/E64Q/N65D) variant outside of the tumor environment.

Example 13: NKG2D-Targeted IL-15/Rα-Fc Fusions Selectively Expand CD8$^+$ T Cells and NK Cells As alluded to above, CD4 effector T cells are thought to contribute to great amounts of cytokine release compared to CD8 effectors which could lead to toxic cytokine release syndrome. Moreover, the CD4 T cell subset includes regulatory T cells, whose expansion can potentially lead to immune suppression and have a negative impact on long-term tumor suppression.

13A: NKG2D is Selectively Expressed in CD8 T Cells and NK Cells

Human PBMCs were stimulated for 48 hours with 500 ng/ml plate-bound anti-CD3 (OKT3). Cells were stained with the following antibodies: anti-CD3-BUV496 (UCHT1), anti-CD8-PE-Cγ7, anti-CD4-BUV395 (SK3), anti-CD16-BV605 (3G8), anti-CD56-BV605 (HCD56), anti-CD45RA-BV785 (HI100), anti-CD45RO-APC-Fire750 (UCHL1), anti-CCR7-BV711 (G043H7), anti-CD28-BV650 (CD28.2), anti-CD95-BUV737 (DX2), and anti-PD-1-Alexa647 (in-house labeled XENP16432) and analyzed by flow cytometry. Data as depicted in FIGS. 141-142 show that NKG2D is selectively expressed in CD8$^+$ T cells, NK cells, as well as CD3$^+$ CD8-CD4$^-$ T cells. Contrarily, data as depicted in FIG. 143 show that PD-1 is expressed on CD4$^+$ and CD8$^+$ T cells. Therefore if selective expansion of CD8$^+$ T cell (and NK cell) is preferred, surface markers such as NKG2D are preferred for targeting IL-15/Rα-Fc fusions. Notably, the data also show that NKG2D is upregulated upon stimulation of CD8$^+$ T cells and NK cells suggesting that NKG2D-targeting may also enable selective proliferation of activated CD8$^+$ and NK cells in the tumor environment over peripheral T cells.

13B: NKG2D-Targeted IL-15/Rα-Fc Fusions Enable Robust and Selective Expansion of CD8 Effector Memory T Cells and NK Cells In Vitro Human PBMCs were stimulated for 48 hours with 500 ng/ml plate-bound anti-CD3 (OKT3) or 100 ng/ml plate-bound anti-CD3 (OKT)+1 µg/ml plate-bound CD80-Fc. Stimulated PBMCs were labeled with CFSE and incubated with the test articles for 4 days at 37° C. Test articles used were NKG2D-targeted IL-15(N4D/N65D)/Rα-Fc fusions with targeting arm based on MS (XENP27145), mAb A (XENP27635), or 1D7B4 (XENP30592). Controls used were RSV-targeted IL-15/Rα-Fc with either IL-15(N4D/

N65D) or IL-15(D30N/E64Q/N65D) variant. Following incubation with the test articles, cells were stained with the following antibodies: anti-CD3-BUV496 (UCHT1), anti-CD8-PE-Cγ7, anti-CD4-BUV395 (SK3), anti-CD16-BV605 (3G8), anti-CD56-BV605 (HCD56), anti-CD45RA-BV785 (HI100), anti-CD45RO-APC-Fire750 (UCHL1), anti-CCR7-BV711 (G043H7), anti-CD28-BV650 (CD28.2), and anti-CD95-BUV737 (DX2) and analyzed by flow cytometry for proliferation of various cell populations.

Proliferation of various lymphocyte populations was determined based on CFSE dilution (Zombie Aqua to exclude dead cells), data for which are depicted in FIGS. 144-145. The data show that each of the NKG2D-targeted IL-15/Rα-Fc fusions were more potent in inducing proliferation of CD8+ T cells (in particular, CD8 effector memory T cells) and NK cells in comparison to control RSV-targeted IL-15/Rα-Fc fusions. NKG2D-targeted IL-15/Rα-Fc fusions with targeting arm based on MS enabled more potent proliferation of CD8 T and NK cells in comparison to those based on mAb A and 1D7B4. Notably, each of the NKG2D-targeted IL-15/Rα-Fc fusions demonstrated equivalent and low potency in inducing proliferation of CD4+ T cells as RSV-targeted IL-15/Rα-Fc fusions having the same IL-15 variant.

13B(a): Various NKG2D-Arms Demonstrate Distinct Binding Characteristics

To further investigate the NKG2D-arms used in the above NKG2D-targeted IL-15/Rα-Fc fusions, the affinity of the fusions for human and cynomolgus NKG2D were assessed on Octet, as generally described above in Example 5B. In particular, biotinylated human or cynomolgus NKG2D were captured and dipped into multiple concentrations of the NKG2D-targeted IL-15/Rα-Fc fusions. The resulting sensorgrams and dissociation constant ($K_D$) are depicted in FIG. 146. The data show that each of the three NKG2D-targeting arms had different affinity binding for NKG2D. Notably, in data not shown, MS bins to a similar to epitope as mAb A (as well as KYK-2.0, ULBP1, ULBP3, and MICA suggesting that they are blockers of NKG2D ligands); however, both MS and mAb A bin to a separate epitope than 1D7B4. Collectively, this suggests that tuning the NKG2D-targeting arm (such as by affinity tuning or by using NKG2D-targeting arms binding different epitopes) may be useful for tuning the potency of the IL-15/Rα-Fc fusions to optimize therapeutic index. It may be useful to refer to the following affinity ladder: MS (1 nM $K_D$)>KYK-2.0 and mAb D>mAb B>mAb E>1D7B4>mAb C>mAb A>KYK-1.0 (170 nM), where MS has the strongest affinity for NKG2D and KYK-1.0 has the weakest affinity for NKG2D. Therefore, mAb A is a suitable targeting arm if moderate potency is required; while mAb D and mAb E may be the preferred targeting arms if extra potency is required.

13C: NKG2D-Targeted IL-15/Rα-Fc Comprising an IL-15 [D30N/E64Q/N65D] Variant Demonstrates Reduced Potency while Maintaining CD8+ T and NK Cell Selectivity Human PBMCs were stimulated for 48 hours with 500 ng/ml plate-bound anti-CD3 (OKT3). Stimulated PBMCs were labeled with CFSE and incubated with the test articles for 4 days at 37° C. Test articles used were NKG2D-targeted IL-15(N4D/N65D)/Rα-Fc fusions with targeting arm based on mAb A (XENP31077), and NKG2D-targeted IL-15 (D30N/E64Q/N65D)/Rα-Fc fusions with targeting arm based on mAb A (XENP31079) or 1D7B4 (XENP31081). Controls used were RSV-targeted IL-15/Rα-Fc with either IL-15(N4D/N65D) or IL-15(D30N/E64Q/N65D) variant. Proliferation of various lymphocyte populations was determined based on CFSE dilution (Zombie Aqua to exclude dead cells), data for which are depicted in FIG. 147. The data show that NKG2D-targeted IL-15/Rα-Fc fusions with the less potent IL-15[D30N/E64Q/N65D] variant were less potent in inducing proliferation of CD8+ T cells, CD4+ T cells, and NK cells than corresponding NKG2D-targeted IL-15/Rα-Fc fusions with the more potent IL-15[N4D/N65D] variant. Notably, the NKG2D-targeted IL-15/Rα-Fc fusions with IL-15[D30N/E64Q/N65D] variant were still more potent than both lower and higher potency RSV-targeted controls in inducing proliferation of CD8+ T and NK cells; however, the NKG2D-targeted IL-15/Rα-Fc fusions with IL-15 [D30N/E64Q/N65D] variant were less potent than the higher potency RSV-targeted control (and as low in potency as the lower potency RSV-targeted control). Collectively, this indicates that tuning the potency of the IL-15 arm may also be a useful approach for tuning the therapeutic index of the NKG2D-targeted IL-15/Rα-Fc fusions.

13D: NKG2D-Targeted IL-15/Rα-Fc Fusions Enable Robust and Selective Expansion of CD8+ T Cells and NK Cells in a Mouse Tumor Model and Combines Productively with PD-1 Blockade In a first study investigating the in vivo activity of NKG2D-targeted IL-15/Rα-Fc fusions, NSG mice that were MHC I/II-DKO (NSG-DKO) and thus resistant to GVHD (10 per group) were intradermally inoculated with 3×106 pp65-transduced MCF-7 cells on Day −18. Mice were then intraperitoneally injected with 2.5×106 human PBMCs and treated on Day 0 with the following test articles: XENP27635 (NKG2D-targeted IL-15/Rα-Fc fusion with IL-15(N4D/N65D) variant and with targeting arm based on mAb A, sequences for which are depicted in FIG. 122L; 1 mg/kg); 4XENP30362 (control RSV-targeted IL-15/Rα-Fc fusion with IL-15(N4D/N65D) variant; 0.3 mg/kg); XENP30518 (control RSV-targeted IL-15/Rα-Fc fusion with IL-15(D30N/E64Q/N65D) variant; 1 mg/kg); XENP16432 (bivalent anti-PD-1 mAb based on nivolumab; 3 mg/kg), and XENP31123 (a monovalent anti-PD-1 mAb; 0.82 mg/kg). The mice were further treated with the indicated test articles on Days 7, 14, and 21, and blood was drawn once per week.

Data depicting the expansion of various human lymphocyte populations are depicted in FIGS. 148-149 (statistics for cell expansion performed on log-transformed data using unpaired t-test; p<0.05 indicates significant difference). By Day 14, NKG2D-targeted IL-15/Rα-Fc fusion XENP27635 enabled significantly enhanced expansion of CD45+ lymphocytes, CD3+ T cells, CD8+ T cells, and NK cells in comparison to PD-1 blockade or control RSV-targeted IL-15/Rα-Fc fusions. Notably, XENP27635 did not enhance expansion CD4+ T cells in comparison to XENP16432. By Day 21, treatment with XENP27635 maintained enhanced NK cell expansion in comparison to treatment with XENP16432, and resulted in significantly diminished expansion of CD4+ T cells in comparison to treatment with XENP16432. Notably, on both Days 14 and 21, the CD8/CD4 T cell ratio resulting from treatment with XENP27635 was substantially greater than treatment with the other test articles. Data in FIG. 151 depicting activation of human lymphocytes (as indicated by CD25 expression) show that CD8+ T cells are also selectively activated in comparison to CD4+ T cells by the NKG2D-targeted IL-15/Rα-Fc fusion.

In a second study investigating the combination of NKG2D-targeted IL-15/Rα-Fc fusions with PD-1 blockade, NSG-DKO mice (10 per group) were intradermally inoculated with 3×106 pp65-transduced MCF-7 cells on Day −19. Mice were then intraperitoneally injected with 2.5×106 human PBMCs and treated on Day 0 with the following test articles/test article combinations: XENP16432 (bivalent anti-PD-1) alone; XENP16432 in combination with XENP31077 (NKG2D-targeted IL-15/Rα-Fc fusion with IL-15(N4D/N65D) variant, targeting arm based on mAb A, and Xtend M428L/N434S Fc variant, sequences for which are depicted in FIG. 122N; 1 mg/kg); or XENP16432 in combination with XENP30518 (control RSV-targeted IL-15/Rα-Fc fusion with IL-15(D30N/E64Q/N65D) variant; 1 mg/kg). The mice were further treated with the indicated test articles on Days 7, 14, and 21, and blood was drawn once per week.

Data depicting the expansion of various human lymphocyte populations are depicted in FIG. 150 (statistics for cell expansion performed on log-transformed data using unpaired t-test; p<0.05 indicates significant difference). By Day 14, treatment with NKG2D-targeted IL-15/Rα-Fc fusion XENP31077 in combination with XENP16432 enabled significantly enhanced expansion of all lymphocyte populations in comparison to treatment with XENP16432 alone (as well as in comparison to treatment with XENP30518 in combination with XENP16432) indicating productive combination of NKG2D-targeted IL-15/Rα-Fc fusions with PD-1 blockade. Although the XENP31077+ XENP16432 combination significantly enhanced expansion of CD4+ T cell population as well, it should be noted that the CD8/CD4 T cell ratio resulting from the XENP31077+ XENP16432 combination was much greater than without XENP31077.

Collectively, the data show that NKG2D-targeted IL-15/Rα-Fc fusions robustly and selectively expand CD8 T cells and NK cells over CD4 T cells both in vitro and in vivo. The high CD8/CD4 T cell ratio should enable safer and more effective tumor therapy.

SEQUENCE LISTING (1333 sequences)

SEQ ID NO: 1 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 2 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 3 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 4 - protein, 65 aa, Homo sapiens
ITCPPPMSVEHADIWVKSYSLYSRERYICNSGFKRKAGTSSLTECVLNKATNVAHWTTPSLKCIR

SEQ ID NO: 5 - protein, 6 aa, Artificial Sequence
  Description of Artificial Sequence: Synthetic 6xHis tag
HHHHHH

SEQ ID NO: 6 - protein, 9 aa, Artificial Sequence
  Description of Artificial Sequence: Synthetic peptide
NLVPMVATV

SEQ ID NO: 7 - protein, 4 aa, Artificial Sequence
  Description of Artificial Sequence: Synthetic peptide
EPKS

SEQ ID NO: 8 - protein, 5 aa, Artificial Sequence
  Description of Artificial Sequence: Synthetic peptide
  See specification as filed for detailed description of substitutions and preferred embodiments
GSGGS

SEQ ID NO: 9 - protein, 5 aa, Artificial Sequence
  Description of Artificial Sequence: Synthetic peptide
  See specification as filed for detailed description of substitutions and preferred embodiments
GGGGS

SEQ ID NO: 10 - protein, 4 aa, Artificial Sequence
  Description of Artificial Sequence: Synthetic peptide
  See specification as filed for detailed description of substitutions and preferred embodiments
GGGS

SEQ ID NO: 11 - protein, 5 aa, Artificial Sequence
  Description of Artificial Sequence: Synthetic peptide
GGGGS

SEQ ID NO: 12 - protein, 10 aa, Artificial Sequence
  Description of Artificial Sequence: Synthetic peptide
GGGGSGGGGS

SEQ ID NO: 13 - protein, 15 aa, Artificial Sequence
  Description of Artificial Sequence: Synthetic peptide
GGGGSGGGGSGGGGS

SEQ ID NO: 14 - protein, 20 aa, Artificial Sequence
  Description of Artificial Sequence: Synthetic peptide
GGGGSGGGGSGGGGSGGGGS

SEQ ID NO: 15 - protein, 25 aa, Artificial Sequence
  Description of Artificial Sequence: Synthetic peptide
GGGGSGGGGSGGGGSGGGGSGGGGS

SEQ ID NO: 16 - protein, 30 aa, Artificial Sequence
  Description of Artificial Sequence: Synthetic polypeptide
GGGGSGGGGSGGGGSGGGGSGGGGSGGGGS

SEQ ID NO: 17 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 18 - protein, 30 aa, Artificial Sequence
  Description of Artificial Sequence: Synthetic polypeptide
DPALVHQRPAPPGGGGSGGGGSGGGGSGGG

SEQ ID NO: 19 - protein, 5 aa, Artificial Sequence
  Description of Artificial Sequence: Synthetic peptide
GKPGS

SEQ ID NO: 20 - protein, 25 aa, Artificial Sequence
  Description of Artificial Sequence: Synthetic peptide
GKPGSGKPGSGKPGSGKPGSGKPGS

SEQ ID NO: 21 - protein, 30 aa, Artificial Sequence
  Description of Artificial Sequence: Synthetic polypeptide
GKPGSGKPGSGKPGSGKPGSGKPGSGKPGS

SEQ ID NO: 22 - protein, 5 aa, Artificial Sequence
  Description of Artificial Sequence: Synthetic peptide
GGGES

SEQ ID NO: 23 - protein, 18 aa, Artificial Sequence
  Description of Artificial Sequence: Synthetic peptide
GSTSGSGKPGSGEGSTKG

SEQ ID NO: 24 - protein, 14 aa, Artificial Sequence
  Description of Artificial Sequence: Synthetic peptide
IRPRAIGGSKPRVA

SEQ ID NO: 25 - protein, 15 aa, Artificial Sequence
  Description of Artificial Sequence: Synthetic peptide
GKGGSGKGGSGKGGS

SEQ ID NO: 26 - protein, 15 aa, Artificial Sequence
  Description of Artificial Sequence: Synthetic peptide
GGKGSGGKGSGGKGS

SEQ ID NO: 27 - protein, 15 aa, Artificial Sequence
  Description of Artificial Sequence: Synthetic peptide
GGGKSGGGKSGGGKS

SEQ ID NO: 28 - protein, 15 aa, Artificial Sequence
  Description of Artificial Sequence: Synthetic peptide
GKGKSGKGKSGKGKS

SEQ ID NO: 29 - protein, 15 aa, Artificial Sequence
  Description of Artificial Sequence: Synthetic peptide
GGGKSGGKGSGKGGS

SEQ ID NO: 30 - protein, 15 aa, Artificial Sequence
  Description of Artificial Sequence: Synthetic peptide
GKPGSGKPGSGKPGS

SEQ ID NO: 31 - protein, 20 aa, Artificial Sequence
  Description of Artificial Sequence: Synthetic peptide
GKPGSGKPGSGKPGSGKPGS

SEQ ID NO: 32 - protein, 20 aa, Artificial Sequence
  Description of Artificial Sequence: Synthetic peptide
GKGKSGKGKSGKGKSGKGKS

SEQ ID NO: 33 - protein, 14 aa, Artificial Sequence
  Description of Artificial Sequence: Synthetic peptide
STAGDTHLGGEDFD

SEQ ID NO: 34 - protein, 15 aa, Artificial Sequence
  Description of Artificial Sequence: Synthetic peptide
GEGGSGEGGSGEGGS

SEQ ID NO: 35 - protein, 15 aa, Artificial Sequence
  Description of Artificial Sequence: Synthetic peptide
GGEGSGGEGSGGEGS

SEQ ID NO: 36 - protein, 15 aa, Artificial Sequence
  Description of Artificial Sequence: Synthetic peptide
GGGESGGGESGGGES

SEQ ID NO: 37 - protein, 15 aa, Artificial Sequence
  Description of Artificial Sequence: Synthetic peptide
GEGESGEGESGEGES

SEQ ID NO: 38 - protein, 15 aa, Artificial Sequence
  Description of Artificial Sequence: Synthetic peptide
GGGESGGEGSGEGGS

SEQ ID NO: 39 - protein, 20 aa, Artificial Sequence
  Description of Artificial Sequence: Synthetic peptide
GEGESGEGESGEGESGEGES

SEQ ID NO: 40 - protein, 19 aa, Artificial Sequence
  Description of Artificial Sequence: Synthetic peptide
PRGASKSGSASQTGSAPGS

SEQ ID NO: 41 - protein, 19 aa, Artificial Sequence
  Description of Artificial Sequence: Synthetic peptide
GTAAAGAGAAGGAAAGAAG

SEQ ID NO: 42 - protein, 19 aa, Artificial Sequence
  Description of Artificial Sequence: Synthetic peptide
GTSGSSGSGSGGSGSGGGG

SEQ ID NO: 43 - protein, 231 aa, Artificial Sequence
  Description of Artificial Sequence: Synthetic polypeptide
  IL-15/R-alpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 231 aa, Artificial Sequence
  Description of Artificial Sequence: Synthetic polypeptide
  IL-15/R-alpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 45 - protein, 231 aa, Artificial Sequence
  Description of Artificial Sequence: Synthetic polypeptide
  IL-15/R-alpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 231 aa, Artificial Sequence; identical to SEQ ID NO: 44
  Description of Artificial Sequence: Synthetic polypeptide
  IL-15/R-alpha-Fc monomer 2

SEQ ID NO: 47 - protein, 231 aa, Artificial Sequence; identical to SEQ ID NO: 45
  Description of Artificial Sequence: Synthetic polypeptide
  IL-15/R-alpha-Fc monomer 1

SEQ ID NO: 48 - protein, 231 aa, Artificial Sequence
  Description of Artificial Sequence: Synthetic polypeptide
  IL-15/R-alpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 49 - protein, 231 aa, Artificial Sequence
  Description of Artificial Sequence: Synthetic polypeptide
  IL-15/R-alpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 50 - protein, 231 aa, Artificial Sequence
  Description of Artificial Sequence: Synthetic polypeptide
  IL-15/R-alpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 51 - protein, 231 aa, Artificial Sequence
  Description of Artificial Sequence: Synthetic polypeptide
  IL-15/R-alpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 231 aa, Artificial Sequence
  Description of Artificial Sequence: Synthetic polypeptide
  IL-15/R-alpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 53 - protein, 231 aa, Artificial Sequence
  Description of Artificial Sequence: Synthetic polypeptide
  IL-15/R-alpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 231 aa, Artificial Sequence
  Description of Artificial Sequence: Synthetic polypeptide
  IL-15/R-alpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 55 - protein, 231 aa, Artificial Sequence
  Description of Artificial Sequence: Synthetic polypeptide
  IL-15/R-alpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 231 aa, Artificial Sequence
  Description of Artificial Sequence: Synthetic polypeptide
  IL-15/R-alpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 57 - protein, 229 aa, Artificial Sequence
  Description of Artificial Sequence: Synthetic polypeptide
  IL-15/R-alpha-Fc monomer 1
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 58 - protein, 229 aa, Artificial Sequence
  Description of Artificial Sequence: Synthetic polypeptide
  IL-15/R-alpha-Fc monomer 2
ESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 59 - protein, 228 aa, Artificial Sequence
  Description of Artificial Sequence: Synthetic polypeptide
  IL-15/R-alpha-Fc monomer 1
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 60 - protein, 228 aa, Artificial Sequence
  Description of Artificial Sequence: Synthetic polypeptide
  IL-15/R-alpha-Fc monomer 2
ERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 61 - protein, 228 aa, Artificial Sequence
  Description of Artificial Sequence: Synthetic polypeptide
  IL-15/R-alpha-Fc monomer 1
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 62 - protein, 228 aa, Artificial Sequence
  Description of Artificial Sequence: Synthetic polypeptide
  IL-15/R-alpha-Fc monomer 2
ERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 63 - protein, 231 aa, Artificial Sequence
  Description of Artificial Sequence: Synthetic polypeptide
  IL-15/R-alpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 64 - protein, 231 aa, Artificial Sequence
  Description of Artificial Sequence: Synthetic polypeptide
  IL-15/R-alpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 65 - protein, 231 aa, Artificial Sequence
  Description of Artificial Sequence: Synthetic polypeptide
  IL-15/R-alpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 231 aa, Artificial Sequence; identical to SEQ ID NO: 65
  Description of Artificial Sequence: Synthetic polypeptide
  IL-15/R-alpha-Fc monomer 2

SEQ ID NO: 67 - protein, 231 aa, Artificial Sequence; identical to SEQ ID NO: 44
  Description of Artificial Sequence: Synthetic polypeptide
  IL-15/R-alpha-Fc monomer 1

SEQ ID NO: 68 - protein, 231 aa, Artificial Sequence
  Description of Artificial Sequence: Synthetic polypeptide
  IL-15/R-alpha-Fc monomer 2
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 329 aa, Artificial Sequence
  Description of Artificial Sequence: Synthetic polypeptide
  IL-15/R-alpha x anti-CD8 Backbone 1 Chain 1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 231 aa, Artificial Sequence; identical to SEQ ID NO: 44
  Description of Artificial Sequence: Synthetic polypeptide
  IL-15/R-alpha x anti-CD8 Backbone 1 Chain 2

SEQ ID NO: 71 - protein, 329 aa, Artificial Sequence
  Description of Artificial Sequence: Synthetic polypeptide
  IL-15/R-alpha x anti-CD8 Backbone 2 Chain 1
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 72 - protein, 231 aa, Artificial Sequence; identical to SEQ ID NO: 43
  Description of Artificial Sequence: Synthetic polypeptide
  IL-15/R-alpha x anti-CD8 Backbone 2 Chain 2

SEQ ID NO: 73 - protein, 329 aa, Artificial Sequence; identical to SEQ ID NO: 71
  Description of Artificial Sequence: Synthetic polypeptide
  IL-15/R-alpha x anti-CD8 Backbone 3 Chain 1

SEQ ID NO: 74 - protein, 329 aa, Artificial Sequence
  Description of Artificial Sequence: Synthetic polypeptide
  IL-15/R-alpha x anti-CD8 Backbone 3 Chain 2
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 107 aa, Artificial Sequence [sequence omitted]

SEQ ID NO: 76 - protein, 106 aa, Artificial Sequence
  Description of Artificial Sequence: Synthetic polypeptide
  Constant Light Chain - Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 77-110 - skipped (34 entries)

SEQ ID NO: 111 - protein, 162 aa, Homo sapiens; identical to SEQ ID NO: 1

SEQ ID NO: 112 - protein, 114 aa, Homo sapiens; identical to SEQ ID NO: 2

SEQ ID NO: 113 - protein, 267 aa, Homo sapiens; identical to SEQ ID NO: 3

SEQ ID NO: 114 - protein, 175 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 115 - protein, 65 aa, Homo sapiens; identical to SEQ ID NO: 4

SEQ ID NO: 116 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 117 - protein, 214 aa, Homo sapiens
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 118 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 119 - protein, 240 aa, Homo sapiens
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEA

SEQ ID NO: 120-135 - skipped (16 entries)

SEQ ID NO: 136 - protein, 231 aa, Artificial Sequence; identical to SEQ ID NO: 43
  Description of Artificial Sequence: Synthetic polypeptide
  XENP21478 Chain 2 - empty-Fc(216)_IgG1_C220S/PVA_/S267K/S364K /E357Q

SEQ ID NO: 137-140 - skipped (4 entries)

SEQ ID NO: 141 - protein, 231 aa, Artificial Sequence; identical to SEQ ID NO: 43
  Description of Artificial Sequence: Synthetic polypeptide
  XENP21993 Chain 2 - empty_Fc(216)_IgG1_C220S/PVA_/S267K/S364K /E357Q Chain

SEQ ID NO: 142-145 - skipped (4 entries)

SEQ ID NO: 146 - protein, 231 aa, Artificial Sequence; identical to SEQ ID NO: 43
  Description of Artificial Sequence: Synthetic polypeptide
  XENP24013 Chain 2 - empty-Fc(216)_IgG1_C220S/PVA_/S267K/S364K /E357Q

SEQ ID NO: 147 - protein, 114 aa, Artificial Sequence; identical to SEQ ID NO: 2
  Description of Artificial Sequence: Synthetic polypeptide
  XENP21479 Chain 1 - human_IL15_no_tag

SEQ ID NO: 148 - protein, 231 aa, Artificial Sequence; identical to SEQ ID NO: 44
  Description of Artificial Sequence: Synthetic polypeptide
  XENP21479 Chain 2 - empty-Fc(216)_IgG1_pI(-)_Isosteric_A_C220S /PVA_/S267K/L368D/K370S

SEQ ID NO: 149-151 - skipped (3 entries)

SEQ ID NO: 152 - protein, 114 aa, Artificial Sequence; identical to SEQ ID NO: 2
  Description of Artificial Sequence: Synthetic polypeptide
  XENP022366 Chain 1 - human_IL15_no_tag

SEQ ID NO: 153 - protein, 231 aa, Artificial Sequence; identical to SEQ ID NO: 44
  Description of Artificial Sequence: Synthetic polypeptide
  XENP022366 Chain 2 - empty-Fc(216)_IgG1_pI(-)_Isosteric_A_ C220S/PVA_/S267K/L368D/K370S

SEQ ID NO: 154-156 - skipped (3 entries)

SEQ ID NO: 157 - protein, 114 aa, Artificial Sequence; identical to SEQ ID NO: 2
  Description of Artificial Sequence: Synthetic polypeptide
  XENP024348 Chain 1 - IL15 WT

SEQ ID NO: 158-160 - skipped (3 entries)

SEQ ID NO: 161 - protein, 231 aa, Artificial Sequence; identical to SEQ ID NO: 43
  Description of Artificial Sequence: Synthetic polypeptide
  XENP024348 Chain 3 - empty_ Fc(216)_IgG1_C220S/PVA_/S267K /S364K/E357Q

SEQ ID NO: 162-164 - skipped (3 entries)

SEQ ID NO: 165 - protein, 114 aa, Artificial Sequence; identical to SEQ ID NO: 2
  Description of Artificial Sequence: Synthetic polypeptide
  XENP021978 Chain 2 - human_IL15_no_tag

SEQ ID NO: 166-172 - skipped (7 entries)

SEQ ID NO: 173 - protein, 231 aa, Artificial Sequence; identical to SEQ ID NO: 68
  Description of Artificial Sequence: Synthetic polypeptide
  XENP022637 Chain 2 - empty-Fc(216)_IgG1_ISO(+RR)_C220S/PVA_ /S267K/S364K/E357Q

SEQ ID NO: 174 - protein, 114 aa, Artificial Sequence; identical to SEQ ID NO: 2
  Description of Artificial Sequence: Synthetic polypeptide
  XENP022637 Chain 3 - human_IL15_no_tag

SEQ ID NO: 175 - protein, 231 aa, Artificial Sequence; identical to SEQ ID NO: 44
  Description of Artificial Sequence: Synthetic polypeptide
  XENP022638 Chain 1 - empty-Fc(216)_IgG1_pI(-)_Isosteric_A_ C220S/PVA_/S267K/L368D/K370S

SEQ ID NO: 176-178 - skipped (3 entries)

SEQ ID NO: 179 - protein, 114 aa, Artificial Sequence; identical to SEQ ID NO: 2
  Description of Artificial Sequence: Synthetic polypeptide
  XENP022638 Chain 3 - human_IL15

SEQ ID NO: 180-183 - skipped (4 entries)

SEQ ID NO: 184 - protein, 231 aa, Artificial Sequence; identical to SEQ ID NO: 68
  Description of Artificial Sequence: Synthetic polypeptide
  Chain 2 - empty-Fc(216)_IgG1_ISO(+RR)_C220S/PVA_/S267K/S364K/ E357Q (8927)

SEQ ID NO: 185 - protein, 66 aa, Artificial Sequence
  Description of Artificial Sequence: Synthetic polypeptide
  IL-15R-alpha(sushi-D96)
ITCPPPMSVEHADIWVKSYSLYSRERYICNSGFKRKAGTSSLTECVLNKATNVAHWTTPSLKCIRD

SEQ ID NO: 186 - protein, 67 aa, Artificial Sequence
  Description of Artificial Sequence: Synthetic polypeptide
  IL-15R-alpha(sushi-D96/P97)
ITCPPPMSVEHADIWVKSYSLYSRERYICNSGFKRKAGTSSLTECVLNKATNVAHWTTPSLKCIRDP

SEQ ID NO: 187 - protein, 68 aa, Artificial Sequence
  Description of Artificial Sequence: Synthetic polypeptide
  IL-15R-alpha(sushi-D96/P97/A98)
ITCPPPMSVEHADIWVKSYSLYSRERYICNSGFKRKAGTSSLTECVLNKATNVAHWTTPSLKCIRDPA

SEQ ID NO: 188 - protein, 114 aa, Artificial Sequence
  Description of Artificial Sequence: Synthetic polypeptide
  IL-15(E87C)
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTS

SEQ ID NO: 189 - protein, 114 aa, Artificial Sequence
  Description of Artificial Sequence: Synthetic polypeptide
  IL-15(V49C)
NWVNVISDLKKIEDLIQSMHIDATLYTESDVHPSCKVTAMKCFLLELQCISLESGDASIHDTVENLIILANNSLSSNGNVTESGCKECEELEEKNIKEFLQSFVHIVQMFINTS

SEQ ID NO: 190 - protein, 114 aa, Artificial Sequence
  Description of Artificial Sequence: Synthetic polypeptide
  IL-15(L52C)
NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTS

SEQ ID NO: 191 - protein, 114 aa, Artificial Sequence
  Description of Artificial Sequence: Synthetic polypeptide
  IL-15(E89C)
NWVNVISDLKKIEDLIQSMHIDATLYTESDVHPSCKVTAMKCFLLELQVISLESGDASIHDTVENLIILANNSLSSNGNVTESGCKECCELEEKNIKEFLQSFVHIVQMFINTS

SEQ ID NO: 192 - protein, 114 aa, Artificial Sequence
  Description of Artificial Sequence: Synthetic polypeptide
  IL-15(Q48C)
NWVNVISDLKKIEDLIQSMHIDATLYTESDVHPSCKVTAMKCFLLELCVISLESGDASIHDTVENLIILANNSLSSNGNVTESGCKECEELEEKNIKEFLQSFVHIVQMFINTS

SEQ ID NO: 193 - protein, 114 aa, Artificial Sequence
  Description of Artificial Sequence: Synthetic polypeptide
  IL-15(E53C)
NWVNVISDLKKIEDLIQSMHIDATLYTESDVHPSCKVTAMKCFLLELQVISLCSGDASIHDTVENLIILANNSLSSNGNVTESGCKECEELEEKNIKEFLQSFVHIVQMFINTS

SEQ ID NO: 194 - protein, 114 aa, Artificial Sequence
  Description of Artificial Sequence: Synthetic polypeptide
  IL-15(C42S)
NWVNVISDLKKIEDLIQSMHIDATLYTESDVHPSCKVTAMKSFLLELQVISLESGDASIHDTVENLIILANNSLSSNGNVTESGCKECEELEEKNIKEFLQSFVHIVQMFINTS

SEQ ID NO: 195 - protein, 114 aa, Artificial Sequence
  Description of Artificial Sequence: Synthetic polypeptide
  IL-15(L45C)
NWVNVISDLKKIEDLIQSMHIDATLYTESDVHPSCKVTAMKCFLCELQVISLESGDASIHDTVENLIILANNSLSSNGNVTESGCKECEELEEKNIKEFLQSFVHIVQMFINTS

SEQ ID NO: 196 - protein, 67 aa, Artificial Sequence
  Description of Artificial Sequence: Synthetic polypeptide
  IL-15R-alpha(sushi-D96/C97)
ITCPPPMSVEHADIWVKSYSLYSRERYICNSGFKRKAGTSSLTECVLNKATNVAHWTTPSLKCIRDC

SEQ ID NO: 197 - protein, 68 aa, Artificial Sequence
  Description of Artificial Sequence: Synthetic polypeptide
  IL-15R-alpha(sushi-D96/P97/C98)
ITCPPPMSVEHADIWVKSYSLYSRERYICNSGFKRKAGTSSLTECVLNKATNVAHWTTPSLKCIRDPC

SEQ ID NO: 198 - protein, 68 aa, Artificial Sequence
  Description of Artificial Sequence: Synthetic polypeptide
  IL-15R-alpha(sushi-D96/C97/A98)
ITCPPPMSVEHADIWVKSYSLYSRERYICNSGFKRKAGTSSLTECVLNKATNVAHWTTPSLKCIRDCA

SEQ ID NO: 199 - protein, 65 aa, Artificial Sequence
  Description of Artificial Sequence: Synthetic polypeptide
  IL-15R-alpha(sushi-S40C)
ITCPPPMSVEHADIWVKSYSLYSRERYICNSGFKRKAGTCSLTECVLNKATNVAHWTTPSLKCIR

SEQ ID NO: 200 - protein, 65 aa, Artificial Sequence
  Description of Artificial Sequence: Synthetic polypeptide
  IL-15R-alpha(sushi-K34C)
ITCPPPMSVEHADIWVKSYSLYSRERYICNSGFCRKAGTSSLTECVLNKATNVAHWTTPSLKCIR

SEQ ID NO: 201 - protein, 65 aa, Artificial Sequence
  Description of Artificial Sequence: Synthetic polypeptide
  IL-15R-alpha(sushi-G38C)
ITCPPPMSVEHADIWVKSYSLYSRERYICNSGFKRKACTSSLTECVLNKATNVAHWTTPSLKCIR

SEQ ID NO: 202 - protein, 65 aa, Artificial Sequence
  Description of Artificial Sequence: Synthetic polypeptide
  IL-15R-alpha(sushi-L42C)
ITCPPPMSVEHADIWVKSYSLYSRERYICNSGFKRKAGTSSCTECVLNKATNVAHWTTPSLKCIR

SEQ ID NO: 203 - protein, 65 aa, Artificial Sequence
  Description of Artificial Sequence: Synthetic polypeptide
  IL-15R-alpha(sushi-A37C)
ITCPPPMSVEHADIWVKSYSLYSRERYICNSGFKRKCGTSSLTECVLNKATNVAHWTTPSLKCIR

SEQ ID NO: 204-227 - skipped (24 entries)

SEQ ID NO: 228 - protein, 114 aa, Artificial Sequence; identical to SEQ ID NO: 188
  Description of Artificial Sequence: Synthetic polypeptide
  XENP022358 Chain 1 - human_IL15_E87C_no_tag

SEQ ID NO: 229 - protein, 231 aa, Artificial Sequence; identical to SEQ ID NO: 44
  Description of Artificial Sequence: Synthetic polypeptide
  XENP022358 Chain 2 - empty-Fc(216)_IgG1_pI(-)_Isosteric_A_C220S /PVA_/S267K/L368D/K370S

SEQ ID NO: 230-232 - skipped (3 entries)

SEQ ID NO: 233 - protein, 114 aa, Artificial Sequence; identical to SEQ ID NO: 188
  Description of Artificial Sequence: Synthetic polypeptide
  XENP022359 Chain 1 - human_IL15_E87C_no_tag

SEQ ID NO: 234 - protein, 231 aa, Artificial Sequence; identical to SEQ ID NO: 44
  Description of Artificial Sequence: Synthetic polypeptide
  XENP022359 Chain 2 - empty-Fc(216)_IgG1_pI(-)_Isosteric_A_C220S /PVA_/S267K/L368D/K370S

SEQ ID NO: 235-237 - skipped (3 entries)

SEQ ID NO: 238 - protein, 114 aa, Artificial Sequence; identical to SEQ ID NO: 190
  Description of Artificial Sequence: Synthetic polypeptide
  XENP022361 Chain 1 - human_IL15_L52C_no_tag

SEQ ID NO: 239 - protein, 231 aa, Artificial Sequence; identical to SEQ ID NO: 44
  Description of Artificial Sequence: Synthetic polypeptide
  XENP022361 Chain 2 - empty-Fc(216)_IgG1_pI(-)_Isosteric_A_C220S /PVA_/S267K/L368D/K370S

SEQ ID NO: 240-242 - skipped (3 entries)

SEQ ID NO: 243 - protein, 114 aa, Artificial Sequence; identical to SEQ ID NO: 188
  Description of Artificial Sequence: Synthetic polypeptide
  XENP022684 Chain 1 - IL15_E87C

SEQ ID NO: 244-249 - skipped (6 entries)

SEQ ID NO: 250 - protein, 114 aa, Artificial Sequence; identical to SEQ ID NO: 188
  Description of Artificial Sequence: Synthetic polypeptide
  XENP022634 Chain 2 - human_IL15_E87C_no_tag

SEQ ID NO: 251-253 - skipped (3 entries)

SEQ ID NO: 254 - protein, 114 aa, Artificial Sequence; identical to SEQ ID NO: 188
  Description of Artificial Sequence: Synthetic polypeptide
  XENP022635 Chain 2 - human_IL15_E87C_no_tag

SEQ ID NO: 255-257 - skipped (3 entries)

SEQ ID NO: 258 - protein, 114 aa, Artificial Sequence; identical to SEQ ID NO: 190
  Description of Artificial Sequence: Synthetic polypeptide
  XENP022636 Chain 2 - human_IL15_L52C_no_tag

SEQ ID NO: 259-261 - skipped (3 entries)

SEQ ID NO: 262 - protein, 114 aa, Artificial Sequence; identical to SEQ ID NO: 188
  Description of Artificial Sequence: Synthetic polypeptide
  XENP022687 Chain 2 - human_IL15_E87C

SEQ ID NO: 263-265 - skipped (3 entries)

SEQ ID NO: 266 - protein, 231 aa, Artificial Sequence; identical to SEQ ID NO: 68
  Description of Artificial Sequence: Synthetic polypeptide
  XENP022639 Chain 2 - empty-Fc(216)_IgG1_ISO(+RR)_C220S/PVA_ /S267K/S364K/E357Q (8927)

SEQ ID NO: 267 - protein, 114 aa, Artificial Sequence; identical to SEQ ID NO: 188
  Description of Artificial Sequence: Synthetic polypeptide
  XENP022639 Chain 3 - human_IL15_E87C_no_tag (17074)

SEQ ID NO: 268 - protein, 114 aa, Artificial Sequence; identical to SEQ ID NO: 188
  Description of Artificial Sequence: Synthetic polypeptide
  XENP022640 Chain 1 - IL15

SEQ ID NO: 269 - protein, 231 aa, Artificial Sequence; identical to SEQ ID NO: 44
  Description of Artificial Sequence: Synthetic polypeptide
  XENP022640 Chain 2 - empty_Fc(216)_IgG1_pI(-)_Isosteric_A_C220S /PVA_/S267K/L368D/K370S

SEQ ID NO: 270 - protein, 114 aa, Artificial Sequence
  Description of Artificial Sequence: Synthetic polypeptide
  N1D
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 271 - protein, 114 aa, Artificial Sequence
  Description of Artificial Sequence: Synthetic polypeptide
  N4D
NWVDVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 272 - protein, 114 aa, Artificial Sequence
  Description of Artificial Sequence: Synthetic polypeptide
  D8N
NWVNVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 273 - protein, 114 aa, Artificial Sequence
  Description of Artificial Sequence: Synthetic polypeptide
  D30N
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTS

SEQ ID NO: 274 - protein, 114 aa, Artificial Sequence
  Description of Artificial Sequence: Synthetic polypeptide
  D61N
NWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 275 - protein, 114 aa, Artificial Sequence
  Description of Artificial Sequence: Synthetic polypeptide
  E64Q
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 276 - protein, 114 aa, Artificial Sequence
  Description of Artificial Sequence: Synthetic polypeptide
  N65D
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 277 - protein, 114 aa, Artificial Sequence
  Description of Artificial Sequence: Synthetic polypeptide
  Q108E
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 278 - protein, 114 aa, Artificial Sequence
  Description of Artificial Sequence: Synthetic polypeptide
  N1D/D61N
DWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 279 - protein, 114 aa, Artificial Sequence
  Description of Artificial Sequence: Synthetic polypeptide
  N1D/E64Q
DWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 280 - protein, 114 aa, Artificial Sequence
  Description of Artificial Sequence: Synthetic polypeptide
  N4D/D61N
NWVDVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 281 - protein, 114 aa, Artificial Sequence
  Description of Artificial Sequence: Synthetic polypeptide
  N4D/E64Q
NWVDVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 282 - protein, 114 aa, Artificial Sequence
  Description of Artificial Sequence: Synthetic polypeptide
  D8N/D61N
NWVNVISNLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 283 - protein, 114 aa, Artificial Sequence
  Description of Artificial Sequence: Synthetic polypeptide
  D8N/E64Q
NWVNVISNLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 284 - protein, 114 aa, Artificial Sequence
  Description of Artificial Sequence: Synthetic polypeptide
  D61N/E64Q
NWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVQMFINTS

SEQ ID NO: 285 - protein, 114 aa, Artificial Sequence
  Description of Artificial Sequence: Synthetic polypeptide
  E64Q/Q108E
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVEMFINTS

SEQ ID NO: 286 - protein, 114 aa, Artificial Sequence
  Description of Artificial Sequence: Synthetic polypeptide
  N1D/N4D/D8N
DWVDVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 287 - protein, 114 aa, Artificial Sequence
  Description of Artificial Sequence: Synthetic polypeptide
  D61N/E64Q/N65D
NWVNVISDLKKIEDLIQSMHIDATLYTESDVHPSCKVTAMKCFLLELQVISLESGDASIHNTVQDLIILANNSLSSNGNVTESGCKECEELEEKNIKEFLQSFVHIVQMFINTS

SEQ ID NO: 288 - protein, 114 aa, Artificial Sequence
  Description of Artificial Sequence: Synthetic polypeptide
  N1D/D61N/E64Q/Q108E
DWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 289 - protein, 114 aa, Artificial Sequence
  Description of Artificial Sequence: Synthetic polypeptide
  N4D/D61N/E64Q/Q108E
NWVDVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 290 - protein, 114 aa, Artificial Sequence
  Description of Artificial Sequence: Synthetic polypeptide
  N1D/N65D
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 291 - protein, 114 aa, Artificial Sequence
  Description of Artificial Sequence: Synthetic polypeptide
  N1D/Q108E
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 292 - protein, 114 aa, Artificial Sequence
  Description of Artificial Sequence: Synthetic polypeptide
  N4D/N65D
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 293 - protein, 114 aa, Artificial Sequence
  Description of Artificial Sequence: Synthetic polypeptide
  D30N/N65D
NWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTS

SEQ ID NO: 294 - protein, 114 aa, Artificial Sequence
  Description of Artificial Sequence: Synthetic polypeptide
  D30N/Q108E
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVEMFINTS

SEQ ID NO: 295 - protein, 114 aa, Artificial Sequence
  Description of Artificial Sequence: Synthetic polypeptide
  N65D/Q108E
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTS

SEQ ID NO: 296 - protein, 114 aa, Artificial Sequence
  Description of Artificial Sequence: Synthetic polypeptide
  E64Q/N65D
NWVNVISDLKKIEDLIQSMHIDATLYTESDVHPSCKVTAMKCFLLELQVISLESGDASIHDTVQDLIILANNSLSSNGNVTESGCKECEELEEKNIKEFLQSFVHIVQMFINTS

SEQ ID NO: 297 - protein, 114 aa, Artificial Sequence
  Description of Artificial Sequence: Synthetic polypeptide
  N1D/N4D/N65D
DWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 298 - protein, 114 aa, Artificial Sequence
  Description of Artificial Sequence: Synthetic polypeptide
  D30N/E64Q/N65D
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTS

SEQ ID NO: 299 - protein, 114 aa, Artificial Sequence
  Description of Artificial Sequence: Synthetic polypeptide
  N4D/D61N/N65D
NWVDVISDLKKIEDLIQSMHIDATLYTESDVHPSCKVTAMKCFLLELQVISLESGDASIHNTVEDLIILANNSLSSNGNVTESGCKECEELEEKNIKEFLQSFVHIVQMFINTS

SEQ ID NO: 300-375 - skipped (76 entries)

SEQ ID NO: 376 - protein, 231 aa, Artificial Sequence; identical to SEQ ID NO: 43
  Description of Artificial Sequence: Synthetic polypeptide
  XENP24013 Chain 2 - empty-Fc(216)_IgG1_C220S/PVA_/S267K/S364K /E357Q

SEQ ID NO: 377-380 - skipped (4 entries)

SEQ ID NO: 381 - protein, 231 aa, Artificial Sequence; identical to SEQ ID NO: 43
  Description of Artificial Sequence: Synthetic polypeptide
  XENP24014 Chain 2 - empty_Fc(216)_IgG1_C220S/PVA_/S267K/S364K /E357Q

SEQ ID NO: 382-385 - skipped (4 entries)

SEQ ID NO: 386 - protein, 231 aa, Artificial Sequence; identical to SEQ ID NO: 43
  Description of Artificial Sequence: Synthetic polypeptide
  XENP024015 Chain 2 - empty_Fc(216)_IgG1_C220S/PVA_/S267K/S364K /E357Q

SEQ ID NO: 387-390 - skipped (4 entries)

SEQ ID NO: 391 - protein, 231 aa, Artificial Sequence; identical to SEQ ID NO: 43
  Description of Artificial Sequence: Synthetic polypeptide
  XENP024050 Chain 2 - empty_ Fc(216)_IgG1_C220S/PVA_/S267K/S364K /E357Q

SEQ ID NO: 392-395 - skipped (4 entries)

SEQ ID NO: 396 - protein, 231 aa, Artificial Sequence; identical to SEQ ID NO: 63
  Description of Artificial Sequence: Synthetic polypeptide
  XENP24294 Chain 2 - empty_Fc(216)_IgG1_C220S/PVA_/S267K/S364K /E357Q/M428L/N434S

SEQ ID NO: 397-400 - skipped (4 entries)

SEQ ID NO: 401 - protein, 231 aa, Artificial Sequence; identical to SEQ ID NO: 43
  Description of Artificial Sequence: Synthetic polypeptide
  XENP024475 Chain 2 - empty_ Fc(216)_IgG1_C220S/PVA_/S267K/S364K /E357Q

SEQ ID NO: 402-405 - skipped (4 entries)

SEQ ID NO: 406 - protein, 231 aa, Artificial Sequence; identical to SEQ ID NO: 43
  Description of Artificial Sequence: Synthetic polypeptide
  XENP024476 Chain 2 - empty_ Fc(216)_IgG1_C220S/PVA_/S267K/S364K /E357Q

SEQ ID NO: 407-410 - skipped (4 entries)

SEQ ID NO: 411 - protein, 231 aa, Artificial Sequence; identical to SEQ ID NO: 43
  Description of Artificial Sequence: Synthetic polypeptide
  XENP024478 Chain 2 - empty_ Fc(216)_IgG1_C220S/PVA_/S267K/S364K /E357Q

SEQ ID NO: 412-415 - skipped (4 entries)

SEQ ID NO: 416 - protein, 231 aa, Artificial Sequence; identical to SEQ ID NO: 43
  Description of Artificial Sequence: Synthetic polypeptide
  XENP024479 Chain 2 - empty-Fc_Fc(216)_IgG1_C220S/PVA_/S267K /S364K/E357Q

SEQ ID NO: 417-420 - skipped (4 entries)

SEQ ID NO: 421 - protein, 231 aa, Artificial Sequence; identical to SEQ ID NO: 43
  Description of Artificial Sequence: Synthetic polypeptide
  XENP024481 Chain 2 - empty_ Fc(216)_IgG1_C220S/PVA_/S267K/S364K /E357Q

SEQ ID NO: 422-424 - skipped (3 entries)

SEQ ID NO: 425 - protein, 231 aa, Artificial Sequence; identical to SEQ ID NO: 43
  Description of Artificial Sequence: Synthetic polypeptide
  XENP024349 Chain 2 - empty- Fc(216)_IgG1_C220S/PVA_/S267K/S364K /E357Q

SEQ ID NO: 426 - protein, 114 aa, Artificial Sequence; identical to SEQ ID NO: 277
  Description of Artificial Sequence: Synthetic polypeptide
  XENP024349 Chain 3 - IL15_Q108E_(non-covalent)

SEQ ID NO: 427-432 - skipped (6 entries)

SEQ ID NO: 433 - protein, 231 aa, Artificial Sequence; identical to SEQ ID NO: 43
  Description of Artificial Sequence: Synthetic polypeptide
  XENP024890 Chain 3 - empty_Fc(216)_ IgG1_PVA_/S267K/S364K/E357Q

SEQ ID NO: 434 - protein, 114 aa, Artificial Sequence; identical to SEQ ID NO: 298
  Description of Artificial Sequence: Synthetic polypeptide
  XENP25138 Chain 1 - IL15_D30N/E64Q/N65D

SEQ ID NO: 435-437 - skipped (3 entries)

SEQ ID NO: 438 - protein, 231 aa, Artificial Sequence; identical to SEQ ID NO: 43
  Description of Artificial Sequence: Synthetic polypeptide
  XENP25138 Chain 3 - empty_Fc(216)_ IgG1_PVA_/S267K/S364K /E357Q

SEQ ID NO: 439 - protein, 114 aa, Artificial Sequence; identical to SEQ ID NO: 276
  Description of Artificial Sequence: Synthetic polypeptide
  XENP022801 Chain 1 - human_IL15_N65D(non-covalent) (17672)

SEQ ID NO: 440 - protein, 65 aa, Artificial Sequence; identical to SEQ ID NO: 4
  Description of Artificial Sequence: Synthetic polypeptide
  XENP022801 Chain 2 - human_IL15R-alpha(Sushi) (17033)

SEQ ID NO: 441 - protein, 114 aa, Artificial Sequence; identical to SEQ ID NO: 277
  Description of Artificial Sequence: Synthetic polypeptide
  XENP022802 Chain 1 - human_IL15_Q108E(non-covalent) (17673)

SEQ ID NO: 442 - protein, 65 aa, Artificial Sequence; identical to SEQ ID NO: 4
  Description of Artificial Sequence: Synthetic polypeptide
  XENP022802 Chain 2 - human_IL15R-alpha(Sushi) (17033)

SEQ ID NO: 443-445 - skipped (3 entries)

SEQ ID NO: 446 - protein, 114 aa, Artificial Sequence; identical to SEQ ID NO: 277
  Description of Artificial Sequence: Synthetic polypeptide
  XENP024342 Chain 2 -human_IL15(non-covalent; Q108E)

SEQ ID NO: 447 - protein, 231 aa, Artificial Sequence; identical to SEQ ID NO: 44
  Description of Artificial Sequence: Synthetic polypeptide
  XENP023472 Chain 1 - empty_ Fc(216)_IgG1_pI(-)_Isosteric_A_ C220S/PVA_/S267K/L368D/K370S

SEQ ID NO: 448 - protein, 114 aa, Artificial Sequence
  Description of Artificial Sequence: Synthetic polypeptide
  XENP023472 Chain 2 - IL15_N65D/E87C
NWVNVISDLKKIEDLIQSMHIDATLYTESDVHPSCKVTAMKCFLLELQVISLESGDASIHDTVEDLIILANNSLSSNGNVTESGCKCCEELEEKNIKEFLQSFVHIVQMFINTS

SEQ ID NO: 449-451 - skipped (3 entries)

SEQ ID NO: 452 - protein, 231 aa, Artificial Sequence; identical to SEQ ID NO: 44
  Description of Artificial Sequence: Synthetic polypeptide
  XENP023473 Chain 1 - empty_ Fc(216)_IgG1_pI(-)_Isosteric_A_ C220S/PVA_/S267K/L368D/K370S

SEQ ID NO: 453 - protein, 114 aa, Artificial Sequence
  Description of Artificial Sequence: Synthetic polypeptide
  XENP023473 Chain 2 - IL15_N65D/L52C
NWVNVISDLKKIEDLIQSMHIDATLYTESDVHPSCKVTAMKCFLLELQVISCESGDASIHDTVEDLIILANNSLSSNGNVTESGCKECEELEEKNIKEFLQSFVHIVQMFINTS

SEQ ID NO: 454-610 - skipped (157 entries)

SEQ ID NO: 611 - protein, 231 aa, Artificial Sequence; identical to SEQ ID NO: 68
  Description of Artificial Sequence: Synthetic polypeptide
  XENP024317 Chain 3 - empty-Fc

SEQ ID NO: 612-669 - skipped (58 entries)

SEQ ID NO: 670 - protein, 114 aa, Artificial Sequence; identical to SEQ ID NO: 276
  Description of Artificial Sequence: Synthetic polypeptide
  XENP024543 Chain 4 - IL15(N65D)

SEQ ID NO: 671-744 - skipped (74 entries)

SEQ ID NO: 745 - protein, 231 aa, Artificial Sequence; identical to SEQ ID NO: 68
  Description of Artificial Sequence: Synthetic polypeptide
  XENP024321 Chain 3 - empty-Fc

SEQ ID NO: 746-789 - skipped (44 entries)

SEQ ID NO: 790 - protein, 231 aa, Artificial Sequence; identical to SEQ ID NO: 44
  Description of Artificial Sequence: Synthetic polypeptide
  XENP24920 Chain 1 - empty_Fc(216)_IgG1_pI(-)_Isosteric_A_C220S /PVA_/S267K/L368D/K370S

SEQ ID NO: 791-845 - skipped (55 entries)

SEQ ID NO: 846 - protein, 114 aa, Artificial Sequence; identical to SEQ ID NO: 298
  Description of Artificial Sequence: Synthetic polypeptide
  XENP25137 Chain 2 - IL15_D30N/E64Q/N65D

SEQ ID NO: 847 - protein, 449 aa, Artificial Sequence
  Description of Artificial Sequence: Synthetic polypeptide
  XENP15074 Heavy Chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 848 - protein, 213 aa, Artificial Sequence
  Description of Artificial Sequence: Synthetic polypeptide
  XENP15074 Light Chain
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 849 - protein, 442 aa, Artificial Sequence
  Description of Artificial Sequence: Synthetic polypeptide
  XENP16432 Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 850 - protein, 214 aa, Artificial Sequence
  Description of Artificial Sequence: Synthetic polypeptide
  XENP16432 Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 851 - protein, 435 aa, Artificial Sequence
  Description of Artificial Sequence: Synthetic polypeptide
  XENP26007 Chain 1 - human_IL15Ra(sushi)_(GGGGS)5-human_IL15(N4D /N65D;single-Chain)_Fc(216)_IgG1_pI(-)_Isosteric_A_C220S/PVA_/ S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 852 - protein, 449 aa, Artificial Sequence
  Description of Artificial Sequence: Synthetic polypeptide
  XENP26007 Chain 2 - Numax_IgG1_PVA_/S267K/S364K /E357Q Heavy Chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 853 - protein, 213 aa, Artificial Sequence; identical to SEQ ID NO: 848
  Description of Artificial Sequence: Synthetic polypeptide
  XENP26007 Chain 3 - Numax Light Chain

SEQ ID NO: 854 - protein, 350 aa, Artificial Sequence
  Description of Artificial Sequence: Synthetic polypeptide
  XENP20818 Chain 1 - human_IL15_(GGGGS)1_Fc(216)_IgG1_pI(-)_ Isosteric_A_C220S/PVA_/S267K/L368D/K370S
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 855 - protein, 301 aa, Artificial Sequence
  Description of Artificial Sequence: Synthetic polypeptide
  XENP20818 Chain 2 - human_IL15R-alpha(Sushi)_(GGGGS)1_Fc(216) _IgG1_C220S/PVA_/S267K/S364K/E357Q
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 856 - protein, 345 aa, Artificial Sequence
  Description of Artificial Sequence: Synthetic polypeptide
  XENP21475 Chain 1 - human_IL15-Fc(216)_IgG1_pI(-)_Isosteric_A _C220S/PVA_/S267K/L368D/K370S
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 857 - protein, 296 aa, Artificial Sequence
  Description of Artificial Sequence: Synthetic polypeptide
  XENP21475 Chain 2 - human_IL15R-alpha(Sushi)-Fc(216)_IgG1_C220S /PVA_/S267K/S364K/E357Q
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 858 - protein, 440 aa, Artificial Sequence
  Description of Artificial Sequence: Synthetic polypeptide
  XENP21478 Chain 1 - human_IL15R-alpha(sushi)_(GGGGS)6-human_ IL15-Fc(216)_IgG1_pI(-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 859 - protein, 435 aa, Artificial Sequence
  Description of Artificial Sequence: Synthetic polypeptide
  XENP21993 Chain 1 - human_IL15Ra(sushi)_(GGGGS)5-human_IL15 (single-Chain)_Fc(216)_IgG1_pI(-)_Isosteric_A_C220S/PVA_/S267K /L368D/K370S scIL-15/Ra-Fc Chain
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 860 - protein, 435 aa, Artificial Sequence
  Description of Artificial Sequence: Synthetic polypeptide
  XENP24013 Chain 1 - human_IL15Ra(sushi)_(GGGGS)5-human_IL15 (D61N;single-Chain)_Fc(216)_IgG1_pI(-)_Isosteric_A_C220S/PVA_/ S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 861 - protein, 296 aa, Artificial Sequence; identical to SEQ ID NO: 857
  Description of Artificial Sequence: Synthetic polypeptide
  XENP21479 Chain 3 - human_IL15R-alpha(Sushi)-Fc(216)_IgG1_C220S /PVA_/S267K/S364K/E357Q

SEQ ID NO: 862 - protein, 301 aa, Artificial Sequence; identical to SEQ ID NO: 855
  Description of Artificial Sequence: Synthetic polypeptide
  XENP022366 Chain 3 - human_IL15Ra(Sushi)_(GGGGS)1_Fc(216)_IgG1 _C220S/PVA_/S267K/S364K/E357Q

SEQ ID NO: 863 - protein, 296 aa, Artificial Sequence
  Description of Artificial Sequence: Synthetic polypeptide
  XENP024348 Chain 2 - human_IL15Ra(Sushi)_Fc(216)_IgG1_pI(-)_ Isosteric_A_C220S/PVA_/S267K/L368D/K370S
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 864 - protein, 296 aa, Artificial Sequence
  Description of Artificial Sequence: Synthetic polypeptide
  XENP021978 Chain 1 - human_IL15Ra(Sushi)-Fc(216)_IgG1_C220S/PVA _/S267K
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 865 - protein, 415 aa, Artificial Sequence
  Description of Artificial Sequence: Synthetic polypeptide
  XENP021978 human_IL15(single-chain)-human_IL15Ra(Sushi)_Fc(216) _IgG1_C220S/PVA_/S267K
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 866 - protein, 306 aa, Artificial Sequence
  Description of Artificial Sequence: Synthetic polypeptide
  XENP022637 Chain 1 - empty-Fc(216)_IgG1_pI(-)_Isosteric_A_C220S /PVA_/S267K/L368D/K370S_(GGGGS)2_IL15Ra(Sushi)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 867 - protein, 306 aa, Artificial Sequence
  Description of Artificial Sequence: Synthetic polypeptide
  XENP022638 Chain 2 - empty-Fc(216) _IgG1_ISO(+RR)_C220S/PVA_ /S267K/S364K/E357Q_(GGGGS)2_IL15R-alpha(Sushi)
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 868 - protein, 425 aa, Artificial Sequence
  Description of Artificial Sequence: Synthetic polypeptide
  Chain 1 - empty-Fc(216)_IgG1_pI(-)_Isosteric_A_C220S/PVA_/S267K /L368D/K370S_(GGGGS)2_IL15Ra(Sushi)_IL15(single-chain)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 869 - protein, 350 aa, Artificial Sequence
  Description of Artificial Sequence: Synthetic polypeptide
  XENP022013 Chain 1 - human_IL15_E87C_(GGGGS)1_Fc(216)_IgG1_pI (-)_Isosteric_A_C220S/PVA_/S267K/L368D/K370S
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 870 - protein, 303 aa, Artificial Sequence
  Description of Artificial Sequence: Synthetic polypeptide
  XENP022013 Chain 2 - human_IL15Ra(Sushi-D96/C97)_(GGGGS)1_Fc (216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDCGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 871 - protein, 350 aa, Artificial Sequence; identical to SEQ ID NO: 869
  Description of Artificial Sequence: Synthetic polypeptide
  XENP022014 Chain 1 - human_IL15_E87C_(GGGGS)1_Fc(216)_IgG1_pI (-)_Isosteric_A_C220S/PVA_/S267K/L368D/K370S

SEQ ID NO: 872 - protein, 304 aa, Artificial Sequence
  Description of Artificial Sequence: Synthetic polypeptide
  XENP022014 Chain 2 - human_IL15Ra(Sushi-D96/P97/C98)_(GGGGS)1 _Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDPCGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 873 - protein, 350 aa, Artificial Sequence; identical to SEQ ID NO: 869
  Description of Artificial Sequence: Synthetic polypeptide
  XENP022015 Chain 1 - human_IL15_E87C_(GGGGS)1_Fc(216)_IgG1 _pI(-)_Isosteric_A_C220S/PVA_/S267K/L368D/K370S

SEQ ID NO: 874 - protein, 304 aa, Artificial Sequence
  Description of Artificial Sequence: Synthetic polypeptide
  XENP022015 Chain 2 - human_IL15Ra(Sushi-D96/C97/A98)_(GGGGS)1 _Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRDCAGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 875 - protein, 350 aa, Artificial Sequence
  Description of Artificial Sequence: Synthetic polypeptide
  XENP022017 Chain 1 - human_IL15_L52C_(GGGGS)1-_Fc(216)_IgG1 _pI(-)_Isosteric_A_C220S/PVA_/S267K/L368D/K370S
NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 876 - protein, 301 aa, Artificial Sequence
  Description of Artificial Sequence: Synthetic polypeptide
  XENP022017 Chain 2 - human_IL15Ra(Sushi-S40C)_(GGGGS)1_Fc(216) _IgG1_C220S/PVA_/S267K/S364K/E357Q
ITCPPPMSVEHADIWVKSYSLYSRERYICNSGFKRKAGTCSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 877 - protein, 304 aa, Artificial Sequence; identical to SEQ ID NO: 872
  Description of Artificial Sequence: Synthetic polypeptide
  XENP022358 Chain 3 - human_IL15Ra(Sushi-D96/P97/C98)_(GGGGS)1 _Fc(216)_IgG1_C220S/PVA_/S267K/S364K/E357Q

SEQ ID NO: 878 - protein, 304 aa, Artificial Sequence; identical to SEQ ID NO: 874
  Description of Artificial Sequence: Synthetic polypeptide
  XENP022359 Chain 3 - human_IL15Ra(Sushi-D96/C97/A98)_(GGGGS)1 _Fc(216)_IgG1_C220S/PVA_/S267K/S364K/E357Q

SEQ ID NO: 879 - protein, 301 aa, Artificial Sequence; identical to SEQ ID NO: 876
  Description of Artificial Sequence: Synthetic polypeptide
  XENP022361 Chain 3 - human_IL15Ra(Sushi-S40C)_(GGGGS)1_Fc(216) _IgG1_C220S/PVA_/S267K/S364K/E357Q

SEQ ID NO: 880 - protein, 299 aa, Artificial Sequence
  Description of Artificial Sequence: Synthetic polypeptide
  XENP022684 Chain 2 - IL15Ra(Sushi-D96/C97/A98)_Fc(216)_IgG1 _pI(-)_Isosteric_A_C220S/PVA_/S267K/L368D/K370S
ITCPPPMSVEHADIWVKSYSLYSRERYICNSGFKRKAGTSSLTECVLNKATNVAHWTTPSLKCIRDCAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 881 - protein, 298 aa, Artificial Sequence
  Description of Artificial Sequence: Synthetic polypeptide
  XENP022634 Chain 1 - human_IL15Ra(Sushi-D96/C97)-Fc(216)_IgG1 _C220S/PVA_/S267K
ITCPPPMSVEHADIWVKSYSLYSRERYICNSGFKRKAGTSSLTECVLNKATNVAHWTTPSLKCIRDCEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 882 - protein, 299 aa, Artificial Sequence
  Description of Artificial Sequence: Synthetic polypeptide
  XENP022635 Chain 1 - human_IL15Ra(Sushi-D96/C97/A98)-Fc(216) _IgG1_C220S/PVA_/S267K
ITCPPPMSVEHADIWVKSYSLYSRERYICNSGFKRKAGTSSLTECVLNKATNVAHWTTPSLKCIRDCAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 883 - protein, 296 aa, Artificial Sequence
  Description of Artificial Sequence: Synthetic polypeptide
  XENP022636 Chain 1 - human_IL15Ra(Sushi-S40C)-Fc(216)_IgG1 _C220S/PVA_/S267K
ITCPPPMSVEHADIWVKSYSLYSRERYICNSGFKRKAGTCSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 884 - protein, 299 aa, Artificial Sequence; identical to SEQ ID NO: 882
  Description of Artificial Sequence: Synthetic polypeptide
  XENP022687 Chain 1 - human_IL15Ra(sushi-D96/C97/A98)_Fc(216) _IgG1_C220S/PVA_/S267K

SEQ ID NO: 885 - protein, 308 aa, Artificial Sequence
  Description of Artificial Sequence: Synthetic polypeptide
  XENP022639 Chain 1 - empty-Fc(216)_IgG1_pI(-)_Isosteric_A _C220S/PVA_/S267K/L368D/K370S_(GGGGS)2 _IL15Ra(Sushi-D96/C97) (17605)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRDC

SEQ ID NO: 886 - protein, 350 aa, Artificial Sequence
  Description of Artificial Sequence: Synthetic polypeptide
  XENP022821 Chain 1 - human_IL15_N65D_(GGGGS)1 (17692)
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 887 - protein, 301 aa, Artificial Sequence; identical to SEQ ID NO: 855
  Description of Artificial Sequence: Synthetic polypeptide
  XENP022821 Chain 2 - human_IL15R-alpha(Sushi)_(GGGGS)1_Fc(216) _IgG1_pI(-)_Isosteric_A_C220S/PVA_/S267K/L368D/K370S-Fc(216) _IgG1_C220S/PVA_/S267K/S364K/E357Q (15908)

SEQ ID NO: 888 - protein, 350 aa, Artificial Sequence
  Description of Artificial Sequence: Synthetic polypeptide
  XENP022822 Chain 1 - human_IL15_Q108E_(GGGGS)1 (17693)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 889 - protein, 301 aa, Artificial Sequence; identical to SEQ ID NO: 855
  Description of Artificial Sequence: Synthetic polypeptide
  XENP022822 Chain 2 - human_IL15R-alpha(Sushi)_(GGGGS)1_Fc(216) _IgG1_pI(-)_Isosteric_A_C220S/PVA_/S267K/L368D/K370S-Fc(216) _IgG1_C220S/PVA_/S267K/S364K/E357Q (15908)

SEQ ID NO: 890 - protein, 350 aa, Artificial Sequence
  Description of Artificial Sequence: Synthetic polypeptide
  XENP23343 Chain 1 - human_IL15_N65D_(GGGGS)1_Fc(216)_IgG1_pI(-) _Isosteric_A_C220S/PVA_/S267K/L368D/K370S/M428L/N434S
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 891 - protein, 301 aa, Artificial Sequence
  Description of Artificial Sequence: Synthetic polypeptide
  XENP23343 Chain 2 - human_IL15Ra(Sushi)_(GGGGS)1_Fc(216)_IgG1 _C220S/PVA_/S267K/S364K/E357Q/M428L/N434S
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 892 - protein, 350 aa, Artificial Sequence
  Description of Artificial Sequence: Synthetic polypeptide
  XENP023554 Chain 1 - human_IL15_N1D/N65D_(GGGGS)1_Fc(216)_IgG1 _pI(-)_Isosteric_A_C220S/PVA_/S267K/L368D/K370S (18783)
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 893 - protein, 301 aa, Artificial Sequence; identical to SEQ ID NO: 855
  Description of Artificial Sequence: Synthetic polypeptide
  XENP023554 Chain 2 - human_IL15Ra(Sushi)_(GGGGS)1_Fc(216)_IgG1 _C220S/PVA_/S267K/S364K/E357Q (15908)

SEQ ID NO: 894 - protein, 350 aa, Artificial Sequence
  Description of Artificial Sequence: Synthetic polypeptide
  XENP023557 Chain 1 - human_IL15_N4D/N65D_(GGGGS)1_Fc(216)_IgG1 _pI(-)_Isosteric_A_C220S/PVA_/S267K/L368D/K370S (18786)
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 895 - protein, 301 aa, Artificial Sequence; identical to SEQ ID NO: 855
  Description of Artificial Sequence: Synthetic polypeptide
  XENP023557 Chain 2 - human_IL15Ra(Sushi)_(GGGGS)1_Fc(216)_IgG1 _C220S/PVA_/S267K/S364K/E357Q (15908)

SEQ ID NO: 896 - protein, 350 aa, Artificial Sequence
  Description of Artificial Sequence: Synthetic polypeptide
  XENP023561 Chain 1 - human_IL15_N65D/Q108E_(GGGGS)1_Fc(216) _IgG1_pI(-)_Isosteric_A_C220S/PVA_/S267K/L368D/K370S
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 897 - protein, 301 aa, Artificial Sequence; identical to SEQ ID NO: 855
  Description of Artificial Sequence: Synthetic polypeptide
  XENP023561 Chain 2 - human_IL15Ra(Sushi)_(GGGGS)1_Fc(216)_IgG1 _C220S/PVA_/S267K/S364K/E357Q

SEQ ID NO: 898 - protein, 345 aa, Artificial Sequence
  Description of Artificial Sequence: Synthetic polypeptide
  XENP024018 Chain 1 - human_IL15(N65D)_Fc(216)_IgG1_pI(-) _Isosteric_A_C220S/PVA_/S267K/L368D/K370S
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 899 - protein, 296 aa, Artificial Sequence; identical to SEQ ID NO: 857
  Description of Artificial Sequence: Synthetic polypeptide
  XENP024018 Chain 2 - human_IL15Ra(Sushi)_Fc(216)_IgG1_C220S/PVA _/S267K/S364K/E357Q

SEQ ID NO: 900 - protein, 345 aa, Artificial Sequence
  Description of Artificial Sequence: Synthetic polypeptide
  XENP024019 Chain 1 - human_IL15(Q108E)-human_IL15Ra(Sushi) _Fc(216)_IgG1_pI(-)_Isosteric_A_C220S/PVA _/S267K/L368D/K370S (19242)
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 901 - protein, 296 aa, Artificial Sequence; identical to SEQ ID NO: 857
  Description of Artificial Sequence: Synthetic polypeptide
  XENP024019 Chain 2 - human_IL15Ra(Sushi)_Fc(216)_IgG1_C220S/PVA _/S267K/S364K/E357Q (16481)

SEQ ID NO: 902 - protein, 350 aa, Artificial Sequence
  Description of Artificial Sequence: Synthetic polypeptide
  XENP024045 Chain 1 - human_IL15_D30N/E64Q/N65D_(GGGGS)1_Fc(216) _IgG1_pI(-)_Isosteric_A_C220S/PVA_/S267K/L368D/K370S
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 903 - protein, 301 aa, Artificial Sequence; identical to SEQ ID NO: 855
  Description of Artificial Sequence: Synthetic polypeptide
  XENP024045 Chain 2 - human_IL15R-alpha(Sushi)_(GGGGS)1_ Fc(216) _IgG1_C220S/PVA_/S267K/S364K/E357Q

SEQ ID NO: 904 - protein, 345 aa, Artificial Sequence
  Description of Artificial Sequence: Synthetic polypeptide
  XENP024051 Chain 1 - human_IL15_N1D/N65D-human_Fc(216)_IgG1 _pI(-)_Isosteric_A_C220S/PVA_/S267K/L368D/K370S
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 905 - protein, 296 aa, Artificial Sequence; identical to SEQ ID NO: 857
  Description of Artificial Sequence: Synthetic polypeptide
  XENP024051 Chain 2 - human_IL15R-alpha(Sushi)_ Fc(216)_IgG1 _C220S/PVA_/S267K/S364K/E357Q

SEQ ID NO: 906 - protein, 345 aa, Artificial Sequence
  Description of Artificial Sequence: Synthetic polypeptide
  XENP024052 Chain 1 - human_IL15_N4D/N65D-human_ Fc(216)_IgG1 _pI(-)_Isosteric_A_C220S/PVA_/S267K/L368D/K370S
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 907 - protein, 296 aa, Artificial Sequence; identical to SEQ ID NO: 857
  Description of Artificial Sequence: Synthetic polypeptide
  XENP024052 Chain 2 - human_IL15R-alpha(Sushi)_Fc(216)_IgG1 _C220S/PVA_/S267K/S364K/E357Q

SEQ ID NO: 908 - protein, 350 aa, Artificial Sequence
  Description of Artificial Sequence: Synthetic polypeptide
  XENP24306 Chain 1 - human_IL15_D30N/E64Q/N65D_(GGGGS)1_Fc(216) _IgG1_pI(-)_Isosteric_A_C220S/PVA_/S267K/L368D/K370S/M428L/N434S
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 909 - protein, 301 aa, Artificial Sequence; identical to SEQ ID NO: 891
  Description of Artificial Sequence: Synthetic polypeptide
  XENP24306 Chain 2 - human_IL15Ra(Sushi)_(GGGGS)1_Fc(216)_IgG1 _C220S/PVA_/S267K/S364K/E357Q/M428L/N434S

SEQ ID NO: 910 - protein, 435 aa, Artificial Sequence; identical to SEQ ID NO: 860
  Description of Artificial Sequence: Synthetic polypeptide
  XENP24013 Chain 1 - human_IL15Ra(sushi)_(GGGGS)5-human _IL15(D61N;single-Chain)_Fc(216)_IgG1_pI(-)_Isosteric_A _C220S/PVA_/S267K/L368D/K370S

SEQ ID NO: 911 - protein, 435 aa, Artificial Sequence
  Description of Artificial Sequence: Synthetic polypeptide
  XENP24014 Chain 1 - human_IL15Ra(sushi)_(GGGGS)5-human _IL15(N65D;single-Chain)_Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 912 - protein, 435 aa, Artificial Sequence
  Description of Artificial Sequence: Synthetic polypeptide
  XENP024015 Chain 1 - human_IL15Ra(sushi)_(GGGGS)5-human _IL15(Q108E;single-chain) _Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 913 - protein, 435 aa, Artificial Sequence; identical to SEQ ID NO: 851
  Description of Artificial Sequence: Synthetic polypeptide
  XENP024050 Chain 1 - human_IL15Ra(sushi)_(GGGGS)5-human_IL15 _N4D/N65D_(single-chain)_Fc(216)_IgG1_pI(-)_Isosteric_A _C220S/PVA_/S267K/L368D/K370S

SEQ ID NO: 914 - protein, 435 aa, Artificial Sequence
  Description of Artificial Sequence: Synthetic polypeptide
  XENP24294 Chain 1 - human_IL15Ra(sushi)_(GGGGS)5-human_IL15 _N4D/N65D_(single-Chain)_Fc(216)_IgG1_pI(-)_Isosteric_A _C220S/PVA_/S267K/L368D/K370S/M428L/N434S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 915 - protein, 440 aa, Artificial Sequence
  Description of Artificial Sequence: Synthetic polypeptide
  XENP024475 Chain 1 - human_IL15Ra(sushi)_(GGGGS)6-human _IL15(single-chain;Q108E)_Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 916 - protein, 440 aa, Artificial Sequence
  Description of Artificial Sequence: Synthetic polypeptide
  XENP024476 Chain 1 - human_IL15Ra(sushi)_(GGGGS)6-human _IL15(single-chain;N4D/N65D)_Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 917 - protein, 445 aa, Artificial Sequence
  Description of Artificial Sequence: Synthetic polypeptide
  XENP024478 Chain 1 - human_IL15Ra(sushi)_(GGGGS)7-human _IL15(single-chain;Q108E)_Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 918 - protein, 445 aa, Artificial Sequence
  Description of Artificial Sequence: Synthetic polypeptide
  XENP024479 Chain 1 - human_IL15Ra(sushi)_(GGGGS)7-human _IL15(single-chain;N4D/N65D)_Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 919 - protein, 440 aa, Artificial Sequence
  Description of Artificial Sequence: Synthetic polypeptide
  XENP024481 Chain 1 - human_IL15Ra(sushi)_(30AA_linker _variant)-human_IL15(single-chain;Q108E)_Fc(216)_IgG1_pI(-) _Isosteric_A_C220S/PVA_/S267K/L368D/K370S
ITCPPPMSVEHADIWVKSYSLYSRERYICNSGFKRKAGTSSLTECVLNKATNVAHWTTPSLKCIRDPALVHQRPAPPGGGGSGGGGSGGGGSGGGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 920 - protein, 296 aa, Artificial Sequence; identical to SEQ ID NO: 863
  Description of Artificial Sequence: Synthetic polypeptide
  XENP024349 Chain 1 - human_IL15R-alpha(Sushi)_ Isosteric_A _C220S/PVA_/S267K/L368D/K370S

SEQ ID NO: 921 - protein, 296 aa, Artificial Sequence; identical to SEQ ID NO: 863
  Description of Artificial Sequence: Synthetic polypeptide
  XENP024890 Chain 1 - IL-15_N4D/N65D

SEQ ID NO: 922 - protein, 296 aa, Artificial Sequence; identical to SEQ ID NO: 863
  Description of Artificial Sequence: Synthetic polypeptide
  XENP024890 Chain 2 - human_IL15Ra(Sushi)_Fc(216)_IgG1_pI(-) _Isosteric_A_C220S/PVA_/S267K/L368D/K370S

SEQ ID NO: 923 - protein, 296 aa, Artificial Sequence; identical to SEQ ID NO: 863
  Description of Artificial Sequence: Synthetic polypeptide
  XENP25138 Chain 2 - human_IL15Ra(Sushi)_Fc(216)_IgG1_pI(-) _Isosteric_A_C220S/PVA_/S267K/L368D/K370S

SEQ ID NO: 924 - protein, 296 aa, Artificial Sequence; identical to SEQ ID NO: 864
  Description of Artificial Sequence: Synthetic polypeptide
  XENP024342 Chain 1 - human_IL15R-alpha(Sushi) _Fc(216)_IgG1 _C220S/PVA_/S267K

SEQ ID NO: 925 - protein, 298 aa, Artificial Sequence
  Description of Artificial Sequence: Synthetic polypeptide
  XENP023472 Chain 3 - IL15Ra(Sushi-D96/C97)_Fc(216)_IgG1 _C220S/PVA_/S267K/S364K/E357Q
ITCPPPMSVEHADIWVKSYSLYSRERYICNSGFKRKAGTSSLTECVLNKATNVAHWTTPSLKCIRDCEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 926 - protein, 296 aa, Artificial Sequence
  Description of Artificial Sequence: Synthetic polypeptide
  XENP023473 Chain 3 - IL15Ra(Sushi-S40C)_Fc(216)_IgG1_C220S/PVA _/S267K/S364K/E357Q
ITCPPPMSVEHADIWVKSYSLYSRERYICNSGFKRKAGTCSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 927 - protein, 454 aa, Artificial Sequence
  Description of Artificial Sequence: Synthetic polypeptide
  XENP024541 Chain 1 - monalizumab[NKG2A]_H1L1 Heavy Chain
QVQLVQSGAEVKKPGASVKVSCKASGYTFTSYWMNWVRQAPGQGLEWMGRIDPYDSETHYAQKLQGRVTMTTDTSTSTAYMELRSLRSDDTAVYYCARGGYDFDVGTLYWFFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 928 - protein, 214 aa, Artificial Sequence
  Description of Artificial Sequence: Synthetic polypeptide
  XENP024541 Chain 2 - monalizumab[NKG2A]_H1L1 Light Chain
DIQMTQSPSSLSASVGDRVTITCRASENIYSYLAWYQQKPGKAPKLLIYNAKTLAEGVPSRFSGSGSGTDFTLTISSLQPEDFATYYCQHHYGTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 929 - protein, 454 aa, Artificial Sequence
  Description of Artificial Sequence: Synthetic polypeptide
  XENP024542 Chain 1 - monalizumab[NKG2A]_H0L0 Heavy Chain
QVQLQQPGAELVRPGASVKLSCKASGYTFTSYWMNWVKQRPEQGLQWIGRIDPYDSETHYSQKFKDKAILTVDKSSSTAYMRLSSLTSEDSAVYYCARGGYDFDVGTLYWFFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 930 - protein, 214 aa, Artificial Sequence
  Description of Artificial Sequence: Synthetic polypeptide
  XENP024542 Chain 2 - monalizumab[NKG2A]_H0L0 Light Chain
DIQMTQSPASLSASVGETVTITCRASENIYSYLAWYQQKQGKSPQFLVYNAKTLAEGVPSRFSGSGSGTQFSLKINSLQPEDFGSYYCQHHYGTPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 931 - protein, 444 aa, Artificial Sequence
  Description of Artificial Sequence: Synthetic polypeptide
  XENP024365 Chain 1 - MS[NKG2D]_H0L0 Heavy Chain
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 932 - protein, 215 aa, Artificial Sequence
  Description of Artificial Sequence: Synthetic polypeptide
  XENP024365 Chain 2 - MS[NKG2D]_H0L0 Light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 933 - protein, 435 aa, Artificial Sequence; identical to SEQ ID NO: 911
  Description of Artificial Sequence: Synthetic polypeptide
  XENP024531 Chain 1 - human_IL15R-alpha(sushi)_(GGGGS)5-human _IL15(N65D; single-chain)-Fc

SEQ ID NO: 934 - protein, 454 aa, Artificial Sequence
  Description of Artificial Sequence: Synthetic polypeptide
  XENP024531 Chain 2 - monalizumab[NKG2A]_H1L1 Fab-Fc Heavy Chain
QVQLVQSGAEVKKPGASVKVSCKASGYTFTSYWMNWVRQAPGQGLEWMGRIDPYDSETHYAQKLQGRVTMTTDTSTSTAYMELRSLRSDDTAVYYCARGGYDFDVGTLYWFFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 935 - protein, 214 aa, Artificial Sequence; identical to SEQ ID NO: 928
  Description of Artificial Sequence: Synthetic polypeptide
  XENP024531 Chain 3 - monalizumab[NKG2A]_H1L1 Light Chain

SEQ ID NO: 936 - protein, 435 aa, Artificial Sequence; identical to SEQ ID NO: 912
  Description of Artificial Sequence: Synthetic polypeptide
  XENP024532 Chain 1 - human_IL15R-alpha(sushi)_(GGGGS)5-human _IL15(Q108E; single-chain)-Fc

SEQ ID NO: 937 - protein, 454 aa, Artificial Sequence; identical to SEQ ID NO: 934
  Description of Artificial Sequence: Synthetic polypeptide
  XENP024532 Chain 2 - monalizumab[NKG2A]_H1L1 Fab-Fc Heavy Chain

SEQ ID NO: 938 - protein, 214 aa, Artificial Sequence; identical to SEQ ID NO: 928
  Description of Artificial Sequence: Synthetic polypeptide
  XENP024532 Chain 3 - monalizumab[NKG2A]_H1L1 Light Chain

SEQ ID NO: 939 - protein, 435 aa, Artificial Sequence; identical to SEQ ID NO: 851
  Description of Artificial Sequence: Synthetic polypeptide
  XENP027146 Chain 1 - human_IL15Ra(sushi)_(GGGGS)5-human _IL15(N4D/N65D;single-chain)-Fc

SEQ ID NO: 940 - protein, 454 aa, Artificial Sequence; identical to SEQ ID NO: 934
  Description of Artificial Sequence: Synthetic polypeptide
  XENP027146 Chain 2 - monalizumab_[NKG2A] _H1L1 Fab-Fc Heavy Chain

SEQ ID NO: 941 - protein, 214 aa, Artificial Sequence; identical to SEQ ID NO: 928
  Description of Artificial Sequence: Synthetic polypeptide
  XENP027146 Chain 3 - monalizumab[NKG2A]_H1L1 Light Chain

SEQ ID NO: 942 - protein, 435 aa, Artificial Sequence; identical to SEQ ID NO: 911
  Description of Artificial Sequence: Synthetic polypeptide
  XENP024533 Chain 1 - human_IL15R-alpha(sushi)_(GGGGS)5-human _IL15(N65D; single-chain)-Fc

SEQ ID NO: 943 - protein, 444 aa, Artificial Sequence
  Description of Artificial Sequence: Synthetic polypeptide
  XENP024533 Chain 2 - MS[NKG2D]_H0L0 Fab-Fc Heavy Chain
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 944 - protein, 215 aa, Artificial Sequence; identical to SEQ ID NO: 932
  Description of Artificial Sequence: Synthetic polypeptide
  XENP024533 Chain 3 - MS[NKG2D]_H0L0 Light Chain

SEQ ID NO: 945 - protein, 435 aa, Artificial Sequence; identical to SEQ ID NO: 912
  Description of Artificial Sequence: Synthetic polypeptide
  XENP024534 Chain 1 - human_IL15R-alpha(sushi)_(GGGGS)5-human _IL15(Q108E; single-chain)-Fc

SEQ ID NO: 946 - protein, 444 aa, Artificial Sequence; identical to SEQ ID NO: 943
  Description of Artificial Sequence: Synthetic polypeptide
  XENP024534 Chain 2 - MS[NKG2D]_H0L0 Fab-Fc Heavy Chain

SEQ ID NO: 947 - protein, 215 aa, Artificial Sequence; identical to SEQ ID NO: 932
  Description of Artificial Sequence: Synthetic polypeptide
  XENP024534 Chain 3 - MS[NKG2D]_H0L0 Light Chain

SEQ ID NO: 948 - protein, 435 aa, Artificial Sequence; identical to SEQ ID NO: 851
  Description of Artificial Sequence: Synthetic polypeptide
  XENP027145 Chain 1 - human_IL15Ra(sushi)_(GGGGS)5-human _IL15(N4D/N65D;single-chain)-Fc

SEQ ID NO: 949 - protein, 444 aa, Artificial Sequence; identical to SEQ ID NO: 943
  Description of Artificial Sequence: Synthetic polypeptide
  XENP027145 Chain 2 - MS[NKG2D]_H0L0 Fab-Fc Heavy Chain

SEQ ID NO: 950 - protein, 215 aa, Artificial Sequence; identical to SEQ ID NO: 932
  Description of Artificial Sequence: Synthetic polypeptide
  XENP027145 Chain 3 - MS[NKG2D]_H0L0 Light Chain

SEQ ID NO: 951 - protein, 447 aa, Artificial Sequence
  Description of Artificial Sequence: Synthetic polypeptide
  XENP015076 Chain 1 - 51.1_H0L0 Heavy Chain
QIQLVQSGPELRKPGETVRISCKASGYSFTNFGMIWVKQAPGKGLKWLGWINTYTGEPTYADDLKGRFAFSLETSANTAYLKINNFKNEDMATYFCARKDYAGFFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 952 - protein, 214 aa, Artificial Sequence
  Description of Artificial Sequence: Synthetic polypeptide
  XENP015076 Chain 2 - 51.1_H0L0 Light Chain
DILMTQSPSSMSVSLGDTVSITCHASQDIGSNMGWLQQKPGKSFKALIYHGTNLEYGVPSRFSGSGSGADYSLSISSLESEDFADYYCVQFAQFPYTFGGGTSLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 953 - protein, 447 aa, Artificial Sequence
  Description of Artificial Sequence: Synthetic polypeptide
  XENP015251 Chain 1 - 51.1_H1L1 Heavy Chain
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 954 - protein, 214 aa, Artificial Sequence
  Description of Artificial Sequence: Synthetic polypeptide
  XENP015251 Chain 2 - 51.1_H1L1 Light Chain
DILMTQSPSSLSASVGDRVTITCQASQDIGSNMGWLQQKPGKSFKALIYHGTNLEYGVPSRFSGSGSGADYTLTISSLQPEDFATYYCVQFAQFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 955 - protein, 223 aa, Artificial Sequence
  Description of Artificial Sequence: Synthetic polypeptide
  XENP023647 Chain 1 - 51.1_H1L1_Fab Heavy Chain
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 956 - protein, 214 aa, Artificial Sequence; identical to SEQ ID NO: 954
  Description of Artificial Sequence: Synthetic polypeptide
  XENP023647 Chain 2 - 51.1_H1L1_Fab Light Chain

SEQ ID NO: 957 - protein, 447 aa, Artificial Sequence
  Description of Artificial Sequence: Synthetic polypeptide
  XENP024317 Chain 1 - 51.1[CD8]_H1_L1.60 Heavy Chain
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 958 - protein, 214 aa, Artificial Sequence
  Description of Artificial Sequence: Synthetic polypeptide
  XENP024317 Chain 2 - 51.1[CD8]_H1_L1.60 Light Chain
DILMTQSPSSLSASVGDRVTITCQASQDIGSDMGWLQQKPGKSFKALIYHGTNLEYGVPSRFSGSGSGADYTLTISSLQPEDFATYYCVQFAQFPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 959 - protein, 435 aa, Artificial Sequence; identical to SEQ ID NO: 859
  Description of Artificial Sequence: Synthetic polypeptide
  XENP024114 Chain 1 - human_IL15R-alpha(sushi)_GGGGS)5-human _IL15(single-chain)-Fc

SEQ ID NO: 960 - protein, 447 aa, Artificial Sequence
  Description of Artificial Sequence: Synthetic polypeptide
  XENP024114 Chain 2 - 51.1[CD8]_H1L1 Fab-Fc Heavy Chain
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 961 - protein, 214 aa, Artificial Sequence; identical to SEQ ID NO: 954
  Description of Artificial Sequence: Synthetic polypeptide
  XENP024114 Chain 3 - 51.1[CD8]_H1L1 Fab-Fc Light Chain

SEQ ID NO: 962 - protein, 435 aa, Artificial Sequence; identical to SEQ ID NO: 860
  Description of Artificial Sequence: Synthetic polypeptide
  XENP024115 Chain 1 - human_IL15R-alpha(sushi)_(GGGGS)5-human _IL15(D61N; single-chain)-Fc

SEQ ID NO: 963 - protein, 447 aa, Artificial Sequence; identical to SEQ ID NO: 960
  Description of Artificial Sequence: Synthetic polypeptide
  XENP024115 Chain 2 - 51.1[CD8]_H1L1 Fab-Fc Heavy Chain

SEQ ID NO: 964 - protein, 214 aa, Artificial Sequence; identical to SEQ ID NO: 954
  Description of Artificial Sequence: Synthetic polypeptide
  XENP024115 Chain 3 - 51.1[CD8]_H1L1 Fab-Fc Light Chain

SEQ ID NO: 965 - protein, 435 aa, Artificial Sequence; identical to SEQ ID NO: 911
  Description of Artificial Sequence: Synthetic polypeptide
  XENP024116 Chain 1 - human_IL15R-alpha(sushi)_(GGGGS)5-human _IL15(N65D; single-chain)-Fc

SEQ ID NO: 966 - protein, 447 aa, Artificial Sequence; identical to SEQ ID NO: 960
  Description of Artificial Sequence: Synthetic polypeptide
  XENP024116 Chain 2 - 51.1[CD8]_H1L1 Fab-Fc Heavy Chain

SEQ ID NO: 967 - protein, 214 aa, Artificial Sequence; identical to SEQ ID NO: 954
  Description of Artificial Sequence: Synthetic polypeptide
  XENP024116 Chain 3 - 51.1[CD8]_H1L1 Fab-Fc Light Chain

SEQ ID NO: 968 - protein, 522 aa, Artificial Sequence
  Description of Artificial Sequence: Synthetic polypeptide
  XENP024543 Chain 1 - 51.1[CD8]_H1L1 _Fab-Fc-Heavy Chain-IL15R-alpha(sushi)
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 969 - protein, 447 aa, Artificial Sequence; identical to SEQ ID NO: 960
  Description of Artificial Sequence: Synthetic polypeptide
  XENP024543 Chain 2 - 51.1[CD8]_H1L1 Fab-Fc Heavy Chain

SEQ ID NO: 970 - protein, 214 aa, Artificial Sequence; identical to SEQ ID NO: 954
  Description of Artificial Sequence: Synthetic polypeptide
  XENP024543 Chain 3 - 51.1[CD8]_H1L1 Fab-Fc Light Chain

SEQ ID NO: 971 - protein, 660 aa, Artificial Sequence
  Description of Artificial Sequence: Synthetic polypeptide
  XENP024546 Chain 1 - 51.1[CD8]_H1-Fc-IL15R-alpha(sushi) _(GGGGS)5-IL15(single-chain)
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 972 - protein, 447 aa, Artificial Sequence; identical to SEQ ID NO: 960
  Description of Artificial Sequence: Synthetic polypeptide
  XENP024546 Chain 2 - 51.1[CD8]_H1L1 Fab-Fc Heavy Chain

SEQ ID NO: 973 - protein, 214 aa, Artificial Sequence; identical to SEQ ID NO: 954
  Description of Artificial Sequence: Synthetic polypeptide
  XENP024546 Chain 3 - 51.1[CD8]_H1L1 Light Chain

SEQ ID NO: 974 - protein, 581 aa, Artificial Sequence
  Description of Artificial Sequence: Synthetic polypeptide
  XENP024547 Chain 1 - 51.1[CD8]_H1-IL15(N4D/N65D)-Fc
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 975 - protein, 532 aa, Artificial Sequence
  Description of Artificial Sequence: Synthetic polypeptide
  XENP024547 Chain 2 - 51.1[CD8]_H1-IL15R-alpha(sushi)-Fc
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 976 - protein, 214 aa, Artificial Sequence; identical to SEQ ID NO: 954
  Description of Artificial Sequence: Synthetic polypeptide
  XENP024547 Chain 3 - 51.1[CD8]_H1L1 Light Chain

SEQ ID NO: 977 - protein, 666 aa, Artificial Sequence
  Description of Artificial Sequence: Synthetic polypeptide
  XENP024548 Chain 1 - 51.1[CD8]_H1-IL15R-alpha(sushi) _(GGGGS)5-IL15-Fc
QIQLVQSGAEVKKPGASVKVSCKASGYSFTNFGMIWVRQAPGQGLEWMGWINTYTGEPTYADGFTGRFVFSLDTSVNTAYLQISSLKAEDTAVYFCARKDYAGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 978 - protein, 447 aa, Artificial Sequence; identical to SEQ ID NO: 960
  Description of Artificial Sequence: Synthetic polypeptide
  XENP024548 Chain 2 - 51.1[CD8]_H1L1 Fab-Fc Heavy Chain

SEQ ID NO: 979 - protein, 214 aa, Artificial Sequence; identical to SEQ ID NO: 954
  Description of Artificial Sequence: Synthetic polypeptide
  XENP024548 Chain 3 - 51.1[CD8]_H1L1 Light Chain

SEQ ID NO: 980 - protein, 450 aa, Artificial Sequence
  Description of Artificial Sequence: Synthetic polypeptide
  XENP024025 Chain 1 - 1C11B3[CD8]_H1L1 Heavy Chain
EVQLLESGGGLVQPGGSLRLSCAASGFTFGSYAMSWVRQAPGKGLEWVSTITASGGTTFYADSVKGRFTISRDNSKNTLYLQMNSLRAEDTAVYYCAKDADGYGAIAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 981 - protein, 214 aa, Artificial Sequence
  Description of Artificial Sequence: Synthetic polypeptide
  XENP024025 Chain 2 - 1C11B3[CD8]_H1L1 Light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 982 - protein, 450 aa, Artificial Sequence
  Description of Artificial Sequence: Synthetic polypeptide
  XENP024321 Chain 1 - 1C11B3[CD8]_H1L1 Fab-Fc Heavy Chain
EVQLLESGGGLVQPGGSLRLSCAASGFTFGSYAMSWVRQAPGKGLEWVSTITASGGTTFYADSVKGRFTISRDNSKNTLYLQMNSLRAEDTAVYYCAKDADGYGAIAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 983 - protein, 214 aa, Artificial Sequence; identical to SEQ ID NO: 981
  Description of Artificial Sequence: Synthetic polypeptide
  XENP024321 Chain 2 - 1C11B3[CD8]_H1L1 Fab-Fc Light Chain

SEQ ID NO: 984 - protein, 435 aa, Artificial Sequence; identical to SEQ ID NO: 851
  Description of Artificial Sequence: Synthetic polypeptide
  XENP24736 Chain 1 - human_IL15Ra(sushi)_(GGGGS)5-human _IL15(N4D/N65D;single-Chain)_Fc(216)_IgG1_pI(-)_Isosteric_A _C220S/PVA_/S267K/L368D/K370S

SEQ ID NO: 985 - protein, 450 aa, Artificial Sequence
  Description of Artificial Sequence: Synthetic polypeptide
  XENP24736 Chain 2 - 1C11B3[CD8]_H1_IgG1_PVA _/S267K/S364K/E357Q Heavy Chain
EVQLLESGGGLVQPGGSLRLSCAASGFTFGSYAMSWVRQAPGKGLEWVSTITASGGTTFYADSVKGRFTISRDNSKNTLYLQMNSLRAEDTAVYYCAKDADGYGAIAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 986 - protein, 214 aa, Artificial Sequence; identical to SEQ ID NO: 981
  Description of Artificial Sequence: Synthetic polypeptide
  XENP24736 Chain 3 - 1C11B3[CD8]_L1 Light Chain

SEQ ID NO: 987 - protein, 118 aa, Artificial Sequence
  Description of Artificial Sequence: Synthetic polypeptide
  OKT8_H0.1 (Murine Variable Heavy)
QVKLQESGAELVKPGASVKLSCTASGFNIKDTYIHFVRQRPEQGLEWIGRIDPANDNTLYASKFQGKATITADTSSNTAYMHLSSLTSGDTAVYYCGRGYGYYVFDHWGQGTTVTVSS

SEQ ID NO: 988 - protein, 118 aa, Artificial Sequence
  Description of Artificial Sequence: Synthetic polypeptide
  OKT8_H1 (Humanized Variable Heavy V1)
EVQLQQSGAEVKKPGASVKVSCKASGFNIKDTYIHWVRQAPGKGLEWMGRIDPANDNTLYASKFQGRVTITADTSTNTAYMELSSLRSEDTAVYYCGRGYGYYVFDHWGQGTTVTVSS

SEQ ID NO: 989 - protein, 118 aa, Artificial Sequence
  Description of Artificial Sequence: Synthetic polypeptide
  OKT8_H2 (Humanized Variable Heavy V2)
QVQLVQSGAEVKKPGASVKVSCKASGFNIKDTYIHWVRQAPGKGLEWMGRIDPANDNTLYASKFQGRVTITADTSINTAYMELSRLRSDDTAVYYCGRGYGYYVFDHWGQGTTVTVSS

SEQ ID NO: 990 - protein, 107 aa, Artificial Sequence
  Description of Artificial Sequence: Synthetic polypeptide
  OKT8_L0.1 (Murine Variable Light)
DIKMTQSPSFLAASPGETITINCRTSRSISQYLAWYQEKPGKTNKLLIYSGSTLQSGIPSRFSGSGSGTDFTLTISGLEPEDFAMYYCQQHNENPLTFGAGTKLEIK

SEQ ID NO: 991 - protein, 107 aa, Artificial Sequence
  Description of Artificial Sequence: Synthetic polypeptide
  OKT8_L1 (Humanized Variable Light V1)
DIKMTQSPSSLSASVGDRVTITCRTSRSISQYLAWYQEKPGKTNKLLIYSGSTLQSGIPSRFSGSGSGTDFTLTISSLQPEDFATYYCQQHNENPLTFGAGTKLEIK

SEQ ID NO: 992 - protein, 447 aa, Artificial Sequence
  Description of Artificial Sequence: Synthetic polypeptide
  XENP15075 Heavy Chain
EVQLQQSGAEVKKPGASVKVSCKASGFNIKDTYIHWVRQAPGKGLEWMGRIDPANDNTLYASKFQGRVTITADTSTNTAYMELSSLRSEDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 993 - protein, 214 aa, Artificial Sequence
  Description of Artificial Sequence: Synthetic polypeptide
  XENP15075 Light Chain
DIKMTQSPSSLSASVGDRVTITCRTSRSISQYLAWYQEKPGKTNKLLIYSGSTLQSGIPSRFSGSGSGTDFTLTISSLQPEDFATYYCQQHNENPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 994 - protein, 447 aa, Artificial Sequence
  Description of Artificial Sequence: Synthetic polypeptide
  XENP24920 Chain 2 - OKT8[CD8]_H2_IgG1_PVA _/S267K/S364K/E357Q Heavy Chain
QVQLVQSGAEVKKPGASVKVSCKASGFNIKDTYIHWVRQAPGKGLEWMGRIDPANDNTLYASKFQGRVTITADTSINTAYMELSRLRSDDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 995 - protein, 214 aa, Artificial Sequence; identical to SEQ ID NO: 993
  Description of Artificial Sequence: Synthetic polypeptide
  XENP24920 Chain 3 - OKT8[CD8]_L1 Light Chain

SEQ ID NO: 996 - protein, 435 aa, Artificial Sequence; identical to SEQ ID NO: 851
  Description of Artificial Sequence: Synthetic polypeptide
  XENP24917 Chain 1 - human_IL15Ra(sushi)_(GGGGS)5-human _IL15(N4D/N65D;single-Chain)_Fc(216)_IgG1_pI(-)_Isosteric_A _C220S/PVA_/S267K/L368D/K370S scIL-15/Ra-Fc Chain

SEQ ID NO: 997 - protein, 447 aa, Artificial Sequence
  Description of Artificial Sequence: Synthetic polypeptide
  XENP24917 Chain 2 - OKT8[CD8]_H1_IgG1_PVA _/S267K/S364K/E357Q Heavy Chain
EVQLQQSGAEVKKPGASVKVSCKASGFNIKDTYIHWVRQAPGKGLEWMGRIDPANDNTLYASKFQGRVTITADTSTNTAYMELSSLRSEDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 998 - protein, 214 aa, Artificial Sequence; identical to SEQ ID NO: 993
  Description of Artificial Sequence: Synthetic polypeptide
  XENP24917 Chain 3 - OKT8[CD8]_L1 Light Chain

SEQ ID NO: 999 - protein, 435 aa, Artificial Sequence; identical to SEQ ID NO: 851
  Description of Artificial Sequence: Synthetic polypeptide
  XENP24918 Chain 1 - human_IL15Ra(sushi)_(GGGGS)5-human _IL15(N4D/N65D;single-Chain)_Fc(216)_IgG1_pI(-)_Isosteric_A _C220S/PVA_/S267K/L368D/K370S scIL-15/Ra-Fc Chain

SEQ ID NO: 1000 - protein, 447 aa, Artificial Sequence; identical to SEQ ID NO: 994
  Description of Artificial Sequence: Synthetic polypeptide
  XENP24918 Chain 2 - OKT8[CD8]_H2_IgG1_PVA _/S267K/S364K/E357Q Heavy Chain

SEQ ID NO: 1001 - protein, 214 aa, Artificial Sequence; identical to SEQ ID NO: 993
  Description of Artificial Sequence: Synthetic polypeptide
  XENP24918 Chain 3 - OKT8[CD8]_L1 Light Chain

SEQ ID NO: 1002 - protein, 435 aa, Artificial Sequence; identical to SEQ ID NO: 851
  Description of Artificial Sequence: Synthetic polypeptide
  XENP24919 Chain 1 - human_IL15Ra(sushi)_(GGGGS)5-human _IL15(N4D/N65D;single-Chain)_Fc(216)_IgG1_pI(-)_Isosteric_A _C220S/PVA_/S267K/L368D/K370S scIL-15/Ra-Fc Chain

SEQ ID NO: 1003 - protein, 447 aa, Artificial Sequence
  Description of Artificial Sequence: Synthetic polypeptide
  XENP24919 Chain 2 - OKT8[CD8]_H0.1_IgG1_PVA _/S267K/S364K/E357Q Heavy Chain
QVKLQESGAELVKPGASVKLSCTASGFNIKDTYIHFVRQRPEQGLEWIGRIDPANDNTLYASKFQGKATITADTSSNTAYMHLSSLTSGDTAVYYCGRGYGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1004 - protein, 214 aa, Artificial Sequence
  Description of Artificial Sequence: Synthetic polypeptide
  XENP24919 Chain 3 - OKT8[CD8]_H0.1_L0_IgG1_PVA _/S267K/S364K/E357Q Light Chain
DIKMTQSPSFLAASPGETITINCRTSRSISQYLAWYQEKPGKTNKLLIYSGSTLQSGIPSRFSGSGSGTDFTLTISGLEPEDFAMYYCQQHNENPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1005 - protein, 296 aa, Artificial Sequence; identical to SEQ ID NO: 863
  Description of Artificial Sequence: Synthetic polypeptide
  XENP25137 Chain 1 - human_IL15Ra(Sushi)_Fc(216)_IgG1_pI(-) _Isosteric_A_C220S/PVA _/S267K/L368D/K370S IL-15R-alpha(sushi)-Fc Chain

SEQ ID NO: 1006 - protein, 447 aa, Artificial Sequence; identical to SEQ ID NO: 994
  Description of Artificial Sequence: Synthetic polypeptide
  XENP25137 Chain 3 - OKT8[CD8]_H2_IgG1_PVA _/S267K/S364K/E357Q Heavy Chain

SEQ ID NO: 1007 - protein, 214 aa, Artificial Sequence; identical to SEQ ID NO: 993
  Description of Artificial Sequence: Synthetic polypeptide
  XENP25137 Chain 4 - OKT8[CD8]_L1 Light Chain

SEQ ID NO: 1008 - protein, 118 aa, Artificial Sequence
  Description of Artificial Sequence: Synthetic polypeptide
  OKT8_H2.152 Variable Heavy
QVQLVQSGAEVKKPGASVKVSCKASGFNIKDTYIHWVRQAPGKGLEWMGRIDPDNGETLYASKFQGRVTITADTSINTAYMELSRLRSDDTAVYYCGRGYGYYVFDHWGQGTTVTVSS

SEQ ID NO: 1009 - protein, 118 aa, Artificial Sequence
  Description of Artificial Sequence: Synthetic polypeptide
  OKT8_H2.153 Variable Heavy
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGYYVFDHWGQGTTVTVSS

SEQ ID NO: 1010 - protein, 118 aa, Artificial Sequence
  Description of Artificial Sequence: Synthetic polypeptide
  OKT8_H2.154 Variable Heavy
QVQLVQSGAEVKKPGASVKVSCKASGFNIKDTYIHWVRQAPGKGLEWMGRIDPDNGETLYASKFQGRVTITADTSINTAYMELSRLRSDDTAVYYCGRGYGKYVFDHWGQGTTVTVSS

SEQ ID NO: 1011 - protein, 118 aa, Artificial Sequence
  Description of Artificial Sequence: Synthetic polypeptide
  OKT8_H2.155 Variable Heavy
QVQLVQSGAEVKKPGASVKVSCKASGFNIKDTYIHWVRQAPGKGLEWMGRIDPDNGETLYASKFQGRVTITADTSINTAYMELSRLRSDDTAVYYCGRGYGYYYFDHWGQGTTVTVSS

SEQ ID NO: 1012 - protein, 118 aa, Artificial Sequence
  Description of Artificial Sequence: Synthetic polypeptide
  OKT8_H2.156 Variable Heavy
QVQLVQSGAEVKKPGASVKVSCKASGFNIKDTYIHWVRQAPGKGLEWMGRIDPDNGETLYASKFQGRVTITADTSINTAYMELSRLRSDDTAVYYCGRGWGYYVFDHWGQGTTVTVSS

SEQ ID NO: 1013 - protein, 118 aa, Artificial Sequence
  Description of Artificial Sequence: Synthetic polypeptide
  OKT8_H2.157 Variable Heavy
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGKYVFDHWGQGTTVTVSS

SEQ ID NO: 1014 - protein, 118 aa, Artificial Sequence
  Description of Artificial Sequence: Synthetic polypeptide
  OKT8_H2.158 Variable Heavy
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGYYYFDHWGQGTTVTVSS

SEQ ID NO: 1015 - protein, 118 aa, Artificial Sequence
  Description of Artificial Sequence: Synthetic polypeptide
  OKT8_H2.159 Variable Heavy
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGWGYYVFDHWGQGTTVTVSS

SEQ ID NO: 1016 - protein, 118 aa, Artificial Sequence
  Description of Artificial Sequence: Synthetic polypeptide
  OKT8_H2.160 Variable Heavy
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGYGYYVFDHWGQGTTVTVSS

SEQ ID NO: 1017 - protein, 118 aa, Artificial Sequence
  Description of Artificial Sequence: Synthetic polypeptide
  OKT8_H2.161 Variable Heavy
QVQLVQSGAEVKKPGASVKVSCKASGFNIKDTYIHWVRQAPGKGLEWMGRIDPDNDETLYASKFQGRVTITADTSINTAYMELSRLRSDDTAVYYCGRGYGKYVFDHWGQGTTVTVSS

SEQ ID NO: 1018 - protein, 118 aa, Artificial Sequence
  Description of Artificial Sequence: Synthetic polypeptide
  OKT8_H2.162 Variable Heavy
QVQLVQSGAEVKKPGASVKVSCKASGFNIKDTYIHWVRQAPGKGLEWMGRIDPDNDETLYASKFQGRVTITADTSINTAYMELSRLRSDDTAVYYCGRGYGYYYFDHWGQGTTVTVSS

SEQ ID NO: 1019 - protein, 118 aa, Artificial Sequence
  Description of Artificial Sequence: Synthetic polypeptide
  OKT8_H2.163 Variable Heavy
QVQLVQSGAEVKKPGASVKVSCKASGFNIKDTYIHWVRQAPGKGLEWMGRIDPDNDETLYASKFQGRVTITADTSINTAYMELSRLRSDDTAVYYCGRGWGYYVFDHWGQGTTVTVSS

SEQ ID NO: 1020 - protein, 118 aa, Artificial Sequence
  Description of Artificial Sequence: Synthetic polypeptide
  OKT8_H2.164 Variable Heavy
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGYGKYVFDHWGQGTTVTVSS

SEQ ID NO: 1021 - protein, 118 aa, Artificial Sequence
  Description of Artificial Sequence: Synthetic polypeptide
  OKT8_H2.165 Variable Heavy
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGYGYYYFDHWGQGTTVTVSS

SEQ ID NO: 1022 - protein, 118 aa, Artificial Sequence
  Description of Artificial Sequence: Synthetic polypeptide
  OKT8_H2.166 Variable Heavy
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGWGYYVFDHWGQGTTVTVSS

SEQ ID NO: 1023 - protein, 107 aa, Artificial Sequence
  Description of Artificial Sequence: Synthetic polypeptide
  OKT8_L1.103 Variable Light
AIKMTQSPSSLSASVGDRVTITCRTSRSISKYLAWYQEKPGKTNKLLIYSGSTLQSGIPSRFSGSGSGTDFTLTISSLQPEDFATYYCQQHNENPLTFGAGTKLEIK

SEQ ID NO: 1024 - protein, 107 aa, Artificial Sequence
  Description of Artificial Sequence: Synthetic polypeptide
  OKT8_L1.113 Variable Light
AIKMTQSPSSLSASVGDRVTITCRTSRSISIYLAWYQEKPGKTNKLLIYKGSTLQSGIPSRFSGSGSGTDFTLTISSLQPEDFATYYCQQANENPLTFGAGTKLEIK

SEQ ID NO: 1025 - protein, 435 aa, Artificial Sequence; identical to SEQ ID NO: 851
  Description of Artificial Sequence: Synthetic polypeptide
  XENP26223 Chain 1 - human_IL15Ra(sushi)_(GGGGS)5-human _IL15(N4D/N65D;single-Chain)_Fc(216)_IgG1_pI(-)_Isosteric_A _C220S/PVA_/S267K/L368D/K370S scIL-15/Ra-Fc Chain

SEQ ID NO: 1026 - protein, 447 aa, Artificial Sequence
  Description of Artificial Sequence: Synthetic polypeptide
  XENP26223 Chain 2 - OKT8[CD8]_H2.157_IgG1_PVA _/S267K/S364K/E357Q Heavy Chain
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGKYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1027 - protein, 214 aa, Artificial Sequence
  Description of Artificial Sequence: Synthetic polypeptide
  XENP26223 Chain 3 - OKT8[CD8]_L1.103 Light Chain
AIKMTQSPSSLSASVGDRVTITCRTSRSISKYLAWYQEKPGKTNKLLIYSGSTLQSGIPSRFSGSGSGTDFTLTISSLQPEDFATYYCQQHNENPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1028 - protein, 435 aa, Artificial Sequence; identical to SEQ ID NO: 851
  Description of Artificial Sequence: Synthetic polypeptide
  XENP26224 Chain 1 - human_IL15Ra(sushi)_(GGGGS)5-human _IL15(N4D/N65D;single-Chain)_Fc(216)_IgG1_pI(-)_Isosteric_A _C220S/PVA_/S267K/L368D/K370S scIL-15/Ra-Fc Chain

SEQ ID NO: 1029 - protein, 447 aa, Artificial Sequence
  Description of Artificial Sequence: Synthetic polypeptide
  XENP26224 Chain 2 - OKT8[CD8]_H2.158_IgG1_PVA _/S267K/S364K/E357Q Heavy Chain
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGYYYFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1030 - protein, 214 aa, Artificial Sequence; identical to SEQ ID NO: 1027
  Description of Artificial Sequence: Synthetic polypeptide
  XENP26224 Chain 3 - OKT8[CD8]_L1.103 Light Chain

SEQ ID NO: 1031 - protein, 435 aa, Artificial Sequence; identical to SEQ ID NO: 851
  Description of Artificial Sequence: Synthetic polypeptide
  XENP26227 Chain 1 - human_IL15Ra(sushi)_(GGGGS)5-human _IL15(N4D/N65D;single-Chain)_Fc(216)_IgG1_pI(-)_Isosteric_A _C220S/PVA_/S267K/L368D/K370S scIL-15/Ra-Fc Chain

SEQ ID NO: 1032 - protein, 447 aa, Artificial Sequence
  Description of Artificial Sequence: Synthetic polypeptide
  XENP26227 Chain 2 - OKT8[CD8]_H2.164_IgG1_PVA _/S267K/S364K/E357Q Heavy Chain
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGYGKYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1033 - protein, 214 aa, Artificial Sequence; identical to SEQ ID NO: 1027
  Description of Artificial Sequence: Synthetic polypeptide
  XENP26227 Chain 3 - OKT8[CD8]_L1.103 Light Chain

SEQ ID NO: 1034 - protein, 435 aa, Artificial Sequence; identical to SEQ ID NO: 851
  Description of Artificial Sequence: Synthetic polypeptide
  XENP26229 Chain 1 - human_IL15Ra(sushi)_(GGGGS)5-human _IL15(N4D/N65D;single-Chain)_Fc(216)_IgG1_pI(-)_Isosteric_A _C220S/PVA_/S267K/L368D/K370S scIL-15/Ra-Fc Chain

SEQ ID NO: 1035 - protein, 447 aa, Artificial Sequence
  Description of Artificial Sequence: Synthetic polypeptide
  XENP26229 Chain 2 - OKT8[CD8]_H2.166_IgG1_PVA _/S267K/S364K/E357Q Heavy Chain
QVQLVQSGAEVKKPGASVKVSCKASGFNIKDTYIHWVRQAPGKGLEWMGRIDPDNDETLYASKFQGRVTMTADTSINTAYMELSRLRSDDTAVYYCGRGWGYYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1036 - protein, 214 aa, Artificial Sequence; identical to SEQ ID NO: 1027
  Description of Artificial Sequence: Synthetic polypeptide
  XENP26229 Chain 3 - OKT8[CD8]_L1.103 Light Chain

SEQ ID NO: 1037 - protein, 435 aa, Artificial Sequence; identical to SEQ ID NO: 914
  Description of Artificial Sequence: Synthetic polypeptide
  XENP26585 Chain 1 - human_IL15Ra(sushi)_(GGGGS)5-human _IL15(N4D/N65D;single-Chain)_Fc(216)_IgG1_pI(-)_Isosteric_A _C220S/PVA_/S267K/L368D/K370S/M428L/N434S scIL-15/Ra-Fc Chain

SEQ ID NO: 1038 - protein, 447 aa, Artificial Sequence
  Description of Artificial Sequence: Synthetic polypeptide
  XENP26585 Chain 2 - OKT8[CD8]_H2.157_IgG1_PVA _/S267K/S364K/E357Q/M428L/N434S Heavy Chain
QVQLVQSGAEVKKPGASVKVSCKASGFNIKDTYIHWVRQAPGKGLEWMGRIDPDNGETLYASKFQGRVTMTADTSINTAYMELSRLRSDDTAVYYCGRGYGKYVFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1039 - protein, 214 aa, Artificial Sequence; identical to SEQ ID NO: 1027
  Description of Artificial Sequence: Synthetic polypeptide
  XENP26585 Chain 3 - OKT8[CD8]_L1.103 Light Chain

SEQ ID NO: 1040 - protein, 121 aa, Artificial Sequence
  Description of Artificial Sequence: Synthetic polypeptide
  1D7B4[NKG2D]_H1 Variable Heavy
EVQLLESGGGLVQPGGSLRLSCAASGFTFSSYAMSWVRQAPGKGLEWVSSISASGGSTYYADSVKGRFTISRDNSKNTLYLQMNSLRAEDTAVYYCAKGIFSIYFFYFDYWGQGTLVTVSS

SEQ ID NO: 1041 - protein, 107 aa, Artificial Sequence
  Description of Artificial Sequence: Synthetic polypeptide
  1D7B4[NKG2D]_L1 Variable Light
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 1042 - protein, 118 aa, Artificial Sequence
  Description of Artificial Sequence: Synthetic polypeptide
  KYK-1.0[NKG2D]_H1 Variable Heavy
EVQLVESGGGVVQPGGSLRLSCAASGFTFSSYGMHWVRQAPGKGLEWVAFIRYDGSNKYYADSVKGRFTISRDNSKNTKYLQMNSLRAEDTAVYYCAKDRFGYYLDYWGQGTLVTVSS

SEQ ID NO: 1043 - protein, 108 aa, Artificial Sequence
  Description of Artificial Sequence: Synthetic polypeptide
  KYK-1.0[NKG2D]_L1 Variable Light
QPVLTQPSSVSVAPGETARIPCGGDDIETKSVHWYQQKPGQAPVLVIYDDDDRPSGIPERFFGSNSGNTATLSISRVEAGDEADYYCQVWDDNNDEWVFGGGTQLTVL

SEQ ID NO: 1044 - protein, 121 aa, Artificial Sequence
  Description of Artificial Sequence: Synthetic polypeptide
  KYK-2.0[NKG2D]_H0 Variable Heavy
QVQLVESGGGLVKPGGSLRLSCAASGFTFSSYGMHWVRQAPGKGLEWVAFIRYDGSNKYYADSVKGRFTISRDNSKNTKYLQMNSLRAEDTAVYYCAKDRGLGDGTYFDYWGQGTTVTVSS

SEQ ID NO: 1045 - protein, 110 aa, Artificial Sequence
  Description of Artificial Sequence: Synthetic polypeptide
  KYK-2.0[NKG2D]_L0 Variable Light
QSALTQPASVSGSPGQSITISCSGSSSNIGNNAVNWYQQLPGKAPKLLIYYDDLLPSGVSDRFSGSKSGTSAFLAISGLQSEDEADYYCAAWDDSLNGPVFGGGTKLTVL

SEQ ID NO: 1046 - protein, 117 aa, Artificial Sequence
  Description of Artificial Sequence: Synthetic polypeptide
  11B2D10[NKG2D]_H0 Variable Heavy
QVQLQQSGPELVRPGASVKLSCKASGYTFTSYWMNWVQQRPEQGLEWIGRIDPYDSETHYNQKFKDKAILTVDKSASTAYMQLSSLTSEDSAVYYCAKMGDYSFDYWGQGTTVTVSS

SEQ ID NO: 1047 - protein, 107 aa, Artificial Sequence
  Description of Artificial Sequence: Synthetic polypeptide
  11B2D10[NKG2D]_L0 Variable Light
DIQLTQSPASLSASVGETVTITCRASGNIHNYLAWYQQKQGKSPQVLVYNAKTLADGVPSRFSGSGSGTQYSLKINSLQPEDFGSYYCQHFWSTTWTFGGGTKLEIK

SEQ ID NO: 1048 - protein, 120 aa, Artificial Sequence
  Description of Artificial Sequence: Synthetic polypeptide
  6E5A7[NKG2D]_H0 Variable Heavy
QVQLQQSGPGLVQPSQSLSITCTVSGFSLTIYGVHWVRQSPGKGLEWLGVIWSGGSTDYNAAFISRLSISKDNSKRQVFFKMSSLQANDTAIYYCSRKSHDGYYGVMDYWGQGTTVTVSS

SEQ ID NO: 1049 - protein, 107 aa, Artificial Sequence
  Description of Artificial Sequence: Synthetic polypeptide
  6E5A7[NKG2D]_L0 Variable Light
DIQLTQSPAILSVSPGERVSFSCRASQSIGTSIHWYQQRTNGSPRLLIKYASESISGIPSRFSGSGSGTDFTLSINGVESEDIADYYCQQSNTWPLTFGAGTKLEIK

SEQ ID NO: 1050 - protein, 119 aa, Artificial Sequence
  Description of Artificial Sequence: Synthetic polypeptide
  6H7E7[NKG2D]_H0 Variable Heavy
QVQLQESGPGLVAPSQSLSITCTVSGFSLTSYGVHWIRQPPGKGLEWLGVIWAGGSTNYNSALMSRLSISKDNSKSQVFLKMNSLQIDDTAMYYCARGGYEGAAWFGYWGQGTTVTVSS

SEQ ID NO: 1051 - protein, 106 aa, Artificial Sequence
  Description of Artificial Sequence: Synthetic polypeptide
  6H7E7[NKG2D]_L0 Variable Light
DIQLTQSPAILSASPGEKVTMTCRASSSVSYMHWYQQKPGSSPKPWIYATSNLASGVPARFSGSGSGTSYSLTISRVEAEDAATYYCQQWNSNPLTFGAGTKLEIK

SEQ ID NO: 1052 - protein, 121 aa, Artificial Sequence
  Description of Artificial Sequence: Synthetic polypeptide
  mAb E[NKG2D]_H1 Variable Heavy
EVQLVESGGGLVKPGGSLRLSCAASGFTFSSYSMNWVRQAPGKGLEWVSSITSSSSYIYYADSVKGRFTISRDNAKNSLYLQMNSLRAEDTAVYYCARDRRYFDWFPLDYRGQGTLVTVSS

SEQ ID NO: 1053 - protein, 107 aa, Artificial Sequence
  Description of Artificial Sequence: Synthetic polypeptide
  mAb E[NKG2D]_L1 Variable Light
DIQMTQSPSSLSASVGDRVTITCRASQGISSWLAWYQQKPEKAPKSLIYAASSLQSGVPSRFSGSGSGTDFTLTISSLQPEDFATYYCQQYNGYPYTFGQGTKLEIK

SEQ ID NO: 1054 - protein, 122 aa, Artificial Sequence
  Description of Artificial Sequence: Synthetic polypeptide
  16F31[NKG2D]_H1 Variable Heavy
EVQLVESGGGVVRPGGSLRLSCAASGFTFDDYGMTWVRQAPGKGLEWVSGINWNGGSTGYADSVKGRFTISRDNAKNSLYLQMNSLRAEDTALYYCARERELYYYYYGLDVWGQGTTVTVSS

SEQ ID NO: 1055 - protein, 109 aa, Artificial Sequence
  Description of Artificial Sequence: Synthetic polypeptide
  16F31[NKG2D]_L1 Variable Light
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKR

SEQ ID NO: 1056 - protein, 122 aa, Artificial Sequence
  Description of Artificial Sequence: Synthetic polypeptide
  mAb D[NKG2D]_H1 Variable Heavy
QVQLVQSGAEVKKPGASVKVSCKASGYTFTNYWMHWVRQAPGQGLEWMGEIDPSDIYTNYAQKFQGRVTMTRDTSTSTVYMELSSLRSEDTAVYYCARGIYDGYYVYGMDYWGQGTTVTVSS

SEQ ID NO: 1057 - protein, 107 aa, Artificial Sequence
  Description of Artificial Sequence: Synthetic polypeptide
  mAb D[NKG2D]_L1 Variable Light
YIQMTQSPSSLSASVGDRVTITCRSSQDISNYLNWYQQKPGKAPKLLIYYTSRLHSGVPSRFSGSGSGTDFTFTISSLQPEDIATYYCQQGKTLPRTFGGGTKVEIK

SEQ ID NO: 1058 - protein, 121 aa, Artificial Sequence; identical to SEQ ID NO: 1040
  Description of Artificial Sequence: Synthetic polypeptide
  1D7B4[NKG2D]_H1 Variable Heavy

SEQ ID NO: 1059 - protein, 107 aa, Artificial Sequence; identical to SEQ ID NO: 1041
  Description of Artificial Sequence: Synthetic polypeptide
  1D7B4[NKG2D]_L1 Variable Light

SEQ ID NO: 1060 - protein, 119 aa, Artificial Sequence
  Description of Artificial Sequence: Synthetic polypeptide
  mAb A[NKG2D]_H1 Variable Heavy
QVQLVQSGAEVKKPGASVKVSCKVSGFSLTSYGVHWIRQAPGQGLEWMGVIWAGGSTNYNSKFQGRVTMTKDNSKSTVYMELSSLRSEDTAVYYCARGGYEGAAWFGYWGQGTLVTVSS

SEQ ID NO: 1061 - protein, 119 aa, Artificial Sequence
  Description of Artificial Sequence: Synthetic polypeptide
  mAb A[NKG2D]_H2 Variable Heavy
QVQLQESGPGLVKPSETLSLTCTVSGFSLTSYGVHWIRQPPGKGLEWIGVIWAGGSTNYNPSLKSRVTISKDNSKSQVSLKLSSVTAADTAVYYCARGGYEGAAWFGYWGQGTLVTVSS

SEQ ID NO: 1062 - protein, 106 aa, Artificial Sequence
  Description of Artificial Sequence: Synthetic polypeptide
  mAb A[NKG2D]_L1 Variable Light
DIQLTQSPSSLSASVGDRVTITCRASSSVSYMHWYQQKPGKSPKPLIYATSNLASGVPARFSGSGSGTDYTLTISSLQPEDFATYYCQQWNSNPLTFGAGTKVEIK

SEQ ID NO: 1063 - protein, 106 aa, Artificial Sequence
  Description of Artificial Sequence: Synthetic polypeptide
  mAb A[NKG2D]_L2 Variable Light
DIQLTQSPATLSLSPGERATLSCRASSSVSYMHWYQQKPGQSPRPLIYATSNLASGVPARFSGSGSGTDYTLTISSLEPEDFAVYYCQQWNSNPLTFGAGTKVEIK

SEQ ID NO: 1064 - protein, 117 aa, Artificial Sequence
  Description of Artificial Sequence: Synthetic polypeptide
  mAb B[NKG2D]_H1 Variable Heavy
QVQLVQSGAEVKKPGASVKVSCKASGYTFTSYWMNWVRQAPGQGLEWMGRIDPYDSETHYNQKFQGRVTMTVDKSTSTAYMELSSLRSEDTAVYYCAKMGDYSFDYWGQGTLVTVSS

SEQ ID NO: 1065 - protein, 117 aa, Artificial Sequence
  Description of Artificial Sequence: Synthetic polypeptide
  mAb B[NKG2D]_H2 Variable Heavy
EVQLVQSGAEVKKPGESLRISCKASGYTFTSYWMNWVRQMPGKGLEWMGRIDPYDSETHYNPSFQGHVTISVDKSISTAYLQWSSLKASDTAMYYCAKMGDYSFDYWGQGTLVTVSS

SEQ ID NO: 1066 - protein, 117 aa, Artificial Sequence
  Description of Artificial Sequence: Synthetic polypeptide
  mAb B[NKG2D]_H3 Variable Heavy
EVQLVESGGGLVQPGGSLRLSCAASGYTFTSYWMNWVRQAPGKGLVWVSRIDPYDSETHYNQKVKGRFTISVDKAKSTAYLQMNSLRAEDTAVYYCAKMGDYSFDYWGQGTLVTVSS

SEQ ID NO: 1067 - protein, 107 aa, Artificial Sequence
  Description of Artificial Sequence: Synthetic polypeptide
  mAb B[NKG2D]_L1 Variable Light
DIQLTQSPSSLSASVGDRVTITCRASGNIHNYLAWYQQKPGKSPKVLVYNAKTLADGVPSRFSGSGSGTDYTLTISSLQPEDFATYYCQHFWSTTWTFGGGTKVEIK

SEQ ID NO: 1068 - protein, 107 aa, Artificial Sequence
  Description of Artificial Sequence: Synthetic polypeptide
  mAb B[NKG2D]_L1.1 Variable Light
DIQLTQSPSSLSASVGDRVTITCRASGNIHNYLAWYQQKPGKSPKVLVYNAKTLADGVPSRFSGSGSGTDYTLTISSLQPEDFATYYCQHFWSTPWTFGGGTKVEIK

SEQ ID NO: 1069 - protein, 107 aa, Artificial Sequence
  Description of Artificial Sequence: Synthetic polypeptide
  mAb B[NKG2D]_L2 Variable Light
DIQLTQSPDSLAVSLGERATINCKASGNIHNYLAWYQQKPGQSPKVLVYNAKTLADGVPSRFSGSGSGTDYTLTISSLQAEDVAVYYCQHFWSTTWTFGGGTKVEIK

SEQ ID NO: 1070 - protein, 120 aa, Artificial Sequence
  Description of Artificial Sequence: Synthetic polypeptide
  mAb C[NKG2D]_H1 Variable Heavy
EVQLVESGGGLVQPGGSLRLSCAVSGFSLTIYGVHWVRQAPGKGLEWVSVIWSGGSTDYNAKVKGRFTISKDNSKRTVYLQMNSLRAEDTAVYYCSRKSHDGYYGVMDYWGQGTTVTVSS

SEQ ID NO: 1071 - protein, 120 aa, Artificial Sequence
  Description of Artificial Sequence: Synthetic polypeptide
  mAb C[NKG2D]_H2 Variable Heavy
QVQLVQSGAEVKKPGASVKVSCKVSGFSLTIYGVHWVRQAPGQGLEWMGVIWSGGSTDYNAKFQGRVTMTKDNSKRTVYMELSSLRSEDTAVYYCSRKSHDGYYGVMDYWGQGTTVTVSS

SEQ ID NO: 1072 - protein, 107 aa, Artificial Sequence
  Description of Artificial Sequence: Synthetic polypeptide
  mAb C[NKG2D]_L1 Variable Light
DIQLTQSPDFQSVTPKEKVTITCRASQSIGTSIHWYQQKPDQSPKLLIKYASESISGIPSRFSGSGSGTDFTLTINSLEAEDAATYYCQQSNTWPLTFGAGTKVEIK

SEQ ID NO: 1073 - protein, 107 aa, Artificial Sequence
  Description of Artificial Sequence: Synthetic polypeptide
  mAb C[NKG2D]_L2 Variable Light
DIQLTQSPSSLSASVGDRVTITCRASQSIGTSIHWYQQKPGKSPKLLIKYASESISGIPSRFSGSGSGTDFTLTISSLQPEDFATYYCQQSNTWPLTFGAGTKVEIK

SEQ ID NO: 1074 - protein, 450 aa, Artificial Sequence
  Description of Artificial Sequence: Synthetic polypeptide
  XENP27055 Heavy Chain - 1D7B4[NKG2D]_H1_IgG1_PVA_/S267K
EVQLLESGGGLVQPGGSLRLSCAASGFTFSSYAMSWVRQAPGKGLEWVSSISASGGSTYYADSVKGRFTISRDNSKNTLYLQMNSLRAEDTAVYYCAKGIFSIYFFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1075 - protein, 214 aa, Artificial Sequence; identical to SEQ ID NO: 981
  Description of Artificial Sequence: Synthetic polypeptide
  XENP27055 Light Chain - 1D7B4[NKG2D]_L1

SEQ ID NO: 1076 - protein, 413 aa, Artificial Sequence
  Description of Artificial Sequence: Synthetic polypeptide
  XENP25379 human NKG2D antigen
HHHHHHGGGGSGLNDIFEAQKIEWHEGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSENLYFQGGGGGSNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 1077 - protein, 413 aa, Artificial Sequence
  Description of Artificial Sequence: Synthetic polypeptide
  XENP25380 cynomolgus NKG2D antigen
HHHHHHGGGGSGLNDIFEAQKIEWHEGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGSENLYFQGGGGGSNSLFNQEVQIPLTESYCGPCPKNWICYKNNCYQFFNESKNWYESQASCMSQNASLLKVYSKEDQDLLKLVKSYHWMGLVHIPTNGSWQWEDGSILSPNLLTIIEMQKGDCALYASSFKGYIENCSIPNTYICMQRTV

SEQ ID NO: 1078 - protein, 261 aa, Artificial Sequence
  Description of Artificial Sequence: Synthetic polypeptide
  XENP22490 empty-Fc_IgG1
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGSHHHHHHGGGGSGLNDIFEAQKIEWHEG

SEQ ID NO: 1079 - protein, 435 aa, Artificial Sequence; identical to SEQ ID NO: 851
  Description of Artificial Sequence: Synthetic polypeptide
  XENP27195 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1080 - protein, 450 aa, Artificial Sequence
  Description of Artificial Sequence: Synthetic polypeptide
  XENP27195 Chain 2 - KYK-2.0[NKG2D]_H0_IgG1_Fc(216)_IgG1_PVA _/S267K/S364K/E357Q
QVQLVESGGGLVKPGGSLRLSCAASGFTFSSYGMHWVRQAPGKGLEWVAFIRYDGSNKYYADSVKGRFTISRDNSKNTKYLQMNSLRAEDTAVYYCAKDRGLGDGTYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1081 - protein, 216 aa, Artificial Sequence
  Description of Artificial Sequence: Synthetic polypeptide
  XENP27195 Chain 3 - KYK-2.0[NKG2D]_L0
QSALTQPASVSGSPGQSITISCSGSSSNIGNNAVNWYQQLPGKAPKLLIYYDDLLPSGVSDRFSGSKSGTSAFLAISGLQSEDEADYYCAAWDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1082 - protein, 435 aa, Artificial Sequence; identical to SEQ ID NO: 914
  Description of Artificial Sequence: Synthetic polypeptide
  XENP27197 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S/M428L/N434S

SEQ ID NO: 1083 - protein, 450 aa, Artificial Sequence
  Description of Artificial Sequence: Synthetic polypeptide
  XENP27197 Chain 2 - 1D7B4[NKG2D]_H1_IgG1_PVA _/S267K/S364K/E357Q/M428L/N434S
EVQLLESGGGLVQPGGSLRLSCAASGFTFSSYAMSWVRQAPGKGLEWVSSISASGGSTYYADSVKGRFTISRDNSKNTLYLQMNSLRAEDTAVYYCAKGIFSIYFFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1084 - protein, 214 aa, Artificial Sequence; identical to SEQ ID NO: 981
  Description of Artificial Sequence: Synthetic polypeptide
  XENP27197 Chain 3 - 1D7B4[NKG2D]_L1

SEQ ID NO: 1085 - protein, 435 aa, Artificial Sequence; identical to SEQ ID NO: 851
  Description of Artificial Sequence: Synthetic polypeptide
  XENP27615 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1086 - protein, 446 aa, Artificial Sequence
  Description of Artificial Sequence: Synthetic polypeptide
  XENP27615 Chain 2 - 11B2D10[NKG2D]_H0_IgG1_pI(-)_Isosteric_A _C220S/PVA_/S267K/L368D/K370S-IgG1_PVA_/S267K/S364K/E357Q
QVQLQQSGPELVRPGASVKLSCKASGYTFTSYWMNWVQQRPEQGLEWIGRIDPYDSETHYNQKFKDKAILTVDKSASTAYMQLSSLTSEDSAVYYCAKMGDYSFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1087 - protein, 214 aa, Artificial Sequence
  Description of Artificial Sequence: Synthetic polypeptide
  XENP27615 Chain 3 - 11B2D10[NKG2D]_L0
DIQLTQSPASLSASVGETVTITCRASGNIHNYLAWYQQKQGKSPQVLVYNAKTLADGVPSRFSGSGSGTQYSLKINSLQPEDFGSYYCQHFWSTTWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1088 - protein, 435 aa, Artificial Sequence; identical to SEQ ID NO: 851
  Description of Artificial Sequence: Synthetic polypeptide
  XENP27616 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1089 - protein, 449 aa, Artificial Sequence
  Description of Artificial Sequence: Synthetic polypeptide
  XENP27616 Chain 2 - 6E5A7[NKG2D]_H0_IgG1_pI(-)_Isosteric_A _C220S/PVA_/S267K/L368D/K370S-IgG1_PVA_/S267K/S364K/E357Q
QVQLQQSGPGLVQPSQSLSITCTVSGFSLTIYGVHWVRQSPGKGLEWLGVIWSGGSTDYNAAFISRLSISKDNSKRQVFFKMSSLQANDTAIYYCSRKSHDGYYGVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1090 - protein, 214 aa, Artificial Sequence
  Description of Artificial Sequence: Synthetic polypeptide
  XENP27616 Chain 3 - 6E5A7[NKG2D]_L0
DIQLTQSPAILSVSPGERVSFSCRASQSIGTSIHWYQQRTNGSPRLLIKYASESISGIPSRFSGSGSGTDFTLSINGVESEDIADYYCQQSNTWPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1091 - protein, 435 aa, Artificial Sequence; identical to SEQ ID NO: 851
  Description of Artificial Sequence: Synthetic polypeptide
  XENP27617 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1092 - protein, 448 aa, Artificial Sequence
  Description of Artificial Sequence: Synthetic polypeptide
  XENP27617 Chain 2 - 6H7E7[NKG2D]_H0_IgG1_pI(-)_Isosteric_A _C220S/PVA_/S267K/L368D/K370S-IgG1_PVA_/S267K/S364K/E357Q
QVQLQESGPGLVAPSQSLSITCTVSGFSLTSYGVHWIRQPPGKGLEWLGVIWAGGSTNYNSALMSRLSISKDNSKSQVFLKMNSLQIDDTAMYYCARGGYEGAAWFGYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1093 - protein, 213 aa, Artificial Sequence
  Description of Artificial Sequence: Synthetic polypeptide
  XENP27617 Chain 3 - 6H7E7[NKG2D]_L0
DIQLTQSPAILSASPGEKVTMTCRASSSVSYMHWYQQKPGSSPKPWIYATSNLASGVPARFSGSGSGTSYSLTISRVEAEDAATYYCQQWNSNPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1094 - protein, 435 aa, Artificial Sequence; identical to SEQ ID NO: 851
  Description of Artificial Sequence: Synthetic polypeptide
  XENP27618 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1095 - protein, 450 aa, Artificial Sequence
  Description of Artificial Sequence: Synthetic polypeptide
  XENP27618 Chain 2 - mAb E[NKG2D]_H1_IgG1_pI(-)_Isosteric_A _C220S/PVA_/S267K/L368D/K370S-IgG1_PVA_/S267K/S364K/E357Q
EVQLVESGGGLVKPGGSLRLSCAASGFTFSSYSMNWVRQAPGKGLEWVSSITSSSSYIYYADSVKGRFTISRDNAKNSLYLQMNSLRAEDTAVYYCARDRRYFDWFPLDYRGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1096 - protein, 215 aa, Artificial Sequence
  Description of Artificial Sequence: Synthetic polypeptide
  XENP27618 Chain 3 - mAb E[NKG2D]_L1
DIQMTQSPSSLSASVGDRVTITCRASQGISSWLAWYQQKPEKAPKSLIYAASSLQSGVPSRFSGSGSGTDFTLTISSLQPEDFATYYCQQYNGYPYTFGQGTKLEIKRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1097 - protein, 435 aa, Artificial Sequence; identical to SEQ ID NO: 851
  Description of Artificial Sequence: Synthetic polypeptide
  XENP27619 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1098 - protein, 451 aa, Artificial Sequence
  Description of Artificial Sequence: Synthetic polypeptide
  XENP27619 Chain 2 - 16F31[NKG2D]_H1_IgG1_pI(-)_Isosteric_A _C220S/PVA_/S267K/L368D/K370S-IgG1_PVA_/S267K/S364K/E357Q
EVQLVESGGGVVRPGGSLRLSCAASGFTFDDYGMTWVRQAPGKGLEWVSGINWNGGSTGYADSVKGRFTISRDNAKNSLYLQMNSLRAEDTALYYCARERELYYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1099 - protein, 216 aa, Artificial Sequence
  Description of Artificial Sequence: Synthetic polypeptide
  XENP27619 Chain 3 - 16F31[NKG2D]_L1
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIKRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1100 - protein, 435 aa, Artificial Sequence; identical to SEQ ID NO: 851
  Description of Artificial Sequence: Synthetic polypeptide
  XENP27620 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1101 - protein, 451 aa, Artificial Sequence
  Description of Artificial Sequence: Synthetic polypeptide
  XENP27620 Chain 2 - mAb D[NKG2D]_H1_IgG1_pI(-)_Isosteric_A _C220S/PVA_/S267K/L368D/K370S-IgG1_PVA_/S267K/S364K/E357Q
QVQLVQSGAEVKKPGASVKVSCKASGYTFTNYWMHWVRQAPGQGLEWMGEIDPSDIYTNYAQKFQGRVTMTRDTSTSTVYMELSSLRSEDTAVYYCARGIYDGYYVYGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1102 - protein, 214 aa, Artificial Sequence
  Description of Artificial Sequence: Synthetic polypeptide
  XENP27620 Chain 3 - mAb D[NKG2D]_L1
YIQMTQSPSSLSASVGDRVTITCRSSQDISNYLNWYQQKPGKAPKLLIYYTSRLHSGVPSRFSGSGSGTDFTFTISSLQPEDIATYYCQQGKTLPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1103 - protein, 435 aa, Artificial Sequence; identical to SEQ ID NO: 851
  Description of Artificial Sequence: Synthetic polypeptide
  XENP27621 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1104 - protein, 447 aa, Artificial Sequence
  Description of Artificial Sequence: Synthetic polypeptide
  XENP27621 Chain 2 - KYK-1.0[NKG2D]_H1_IgG1_pI(-)_Isosteric_A _C220S/PVA_/S267K/L368D/K370S-IgG1_PVA_/S267K/S364K/E357Q
EVQLVESGGGVVQPGGSLRLSCAASGFTFSSYGMHWVRQAPGKGLEWVAFIRYDGSNKYYADSVKGRFTISRDNSKNTKYLQMNSLRAEDTAVYYCAKDRFGYYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1105 - protein, 214 aa, Artificial Sequence
  Description of Artificial Sequence: Synthetic polypeptide
  XENP27621 Chain 3 - KYK-1.0[NKG2D]_L1
QPVLTQPSSVSVAPGETARIPCGGDDIETKSVHWYQQKPGQAPVLVIYDDDDRPSGIPERFFGSNSGNTATLSISRVEAGDEADYYCQVWDDNNDEWVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1106 - protein, 435 aa, Artificial Sequence; identical to SEQ ID NO: 851
  Description of Artificial Sequence: Synthetic polypeptide
  XENP27622 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1107 - protein, 446 aa, Artificial Sequence
  Description of Artificial Sequence: Synthetic polypeptide
  XENP27622 Chain 2 - mAb B[NKG2D]_H1_IgG1_pI(-)_Isosteric_A _C220S/PVA_/S267K/L368D/K370S-IgG1_PVA_/S267K/S364K/E357Q
QVQLVQSGAEVKKPGASVKVSCKASGYTFTSYWMNWVRQAPGQGLEWMGRIDPYDSETHYNQKFQGRVTMTVDKSTSTAYMELSSLRSEDTAVYYCAKMGDYSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1108 - protein, 214 aa, Artificial Sequence
  Description of Artificial Sequence: Synthetic polypeptide
  XENP27622 Chain 3 - mAb B[NKG2D]_L1
DIQLTQSPSSLSASVGDRVTITCRASGNIHNYLAWYQQKPGKSPKVLVYNAKTLADGVPSRFSGSGSGTDYTLTISSLQPEDFATYYCQHFWSTTWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1109 - protein, 435 aa, Artificial Sequence; identical to SEQ ID NO: 851
  Description of Artificial Sequence: Synthetic polypeptide
  XENP27623 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1110 - protein, 449 aa, Artificial Sequence
  Description of Artificial Sequence: Synthetic polypeptide
  XENP27623 Chain 2 - mAb B[NKG2D]_H1__IgG1_pI(-)_Isosteric_A _C220S/PVA_/S267K/L368D/K370S-IgG1_PVA_/S267K/S364K/E357Q
EVQLVESGGGLVQPGGSLRLSCAVSGFSLTIYGVHWVRQAPGKGLEWVSVIWSGGSTDYNAKVKGRFTISKDNSKRTVYLQMNSLRAEDTAVYYCSRKSHDGYYGVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1111 - protein, 214 aa, Artificial Sequence
  Description of Artificial Sequence: Synthetic polypeptide
  XENP27623 Chain 3 - mAb B[NKG2D]_L1.1
DIQLTQSPSSLSASVGDRVTITCRASGNIHNYLAWYQQKPGKSPKVLVYNAKTLADGVPSRFSGSGSGTDYTLTISSLQPEDFATYYCQHFWSTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1112 - protein, 435 aa, Artificial Sequence; identical to SEQ ID NO: 851
  Description of Artificial Sequence: Synthetic polypeptide
  XENP27624 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1113 - protein, 448 aa, Artificial Sequence
  Description of Artificial Sequence: Synthetic polypeptide
  XENP27624 Chain 2 - mAb B[NKG2D]_H1_IgG1_pI(-)_Isosteric_A _C220S/PVA_/S267K/L368D/K370S-IgG1_PVA_/S267K/S364K/E357Q
QVQLVQSGAEVKKPGASVKVSCKVSGFSLTSYGVHWIRQAPGQGLEWMGVIWAGGSTNYNSKFQGRVTMTKDNSKSTVYMELSSLRSEDTAVYYCARGGYEGAAWFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1114 - protein, 214 aa, Artificial Sequence
  Description of Artificial Sequence: Synthetic polypeptide
  XENP27624 Chain 3 - mAb B[NKG2D]_L2
DIQLTQSPDSLAVSLGERATINCKASGNIHNYLAWYQQKPGQSPKVLVYNAKTLADGVPSRFSGSGSGTDYTLTISSLQAEDVAVYYCQHFWSTTWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1115 - protein, 435 aa, Artificial Sequence; identical to SEQ ID NO: 851
  Description of Artificial Sequence: Synthetic polypeptide
  XENP27625 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1116 - protein, 446 aa, Artificial Sequence
  Description of Artificial Sequence: Synthetic polypeptide
  XENP27625 Chain 2 - mAb B[NKG2D]_H2_IgG1_pI(-)_Isosteric_A _C220S/PVA_/S267K/L368D/K370S-IgG1_PVA_/S267K/S364K/E357Q
EVQLVQSGAEVKKPGESLRISCKASGYTFTSYWMNWVRQMPGKGLEWMGRIDPYDSETHYNPSFQGHVTISVDKSISTAYLQWSSLKASDTAMYYCAKMGDYSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1117 - protein, 214 aa, Artificial Sequence; identical to SEQ ID NO: 1108
  Description of Artificial Sequence: Synthetic polypeptide
  XENP27625 Chain 3 - mAb B[NKG2D]_L1

SEQ ID NO: 1118 - protein, 435 aa, Artificial Sequence; identical to SEQ ID NO: 851
  Description of Artificial Sequence: Synthetic polypeptide
  XENP27626 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1119 - protein, 446 aa, Artificial Sequence; identical to SEQ ID NO: 1116
  Description of Artificial Sequence: Synthetic polypeptide
  XENP27626 Chain 2 - mAb B[NKG2D]_H2__IgG1_pI(-)_Isosteric_A _C220S/PVA_/S267K/L368D/K370S-IgG1_PVA_/S267K/S364K/E357Q

SEQ ID NO: 1120 - protein, 214 aa, Artificial Sequence; identical to SEQ ID NO: 1111
  Description of Artificial Sequence: Synthetic polypeptide
  XENP27626 Chain 3 - mAb B[NKG2D]_L1.1

SEQ ID NO: 1121 - protein, 435 aa, Artificial Sequence; identical to SEQ ID NO: 851
  Description of Artificial Sequence: Synthetic polypeptide
  XENP27627 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1122 - protein, 446 aa, Artificial Sequence; identical to SEQ ID NO: 1116
  Description of Artificial Sequence: Synthetic polypeptide
  XENP27627 Chain 2 - mAb B[NKG2D]_H2_IgG1_pI(-)_Isosteric_A _C220S/PVA_/S267K/L368D/K370S-IgG1_PVA_/S267K/S364K/E357Q

SEQ ID NO: 1123 - protein, 214 aa, Artificial Sequence; identical to SEQ ID NO: 1114
  Description of Artificial Sequence: Synthetic polypeptide
  XENP27627 Chain 3 - mAb B[NKG2D]_L2

SEQ ID NO: 1124 - protein, 435 aa, Artificial Sequence; identical to SEQ ID NO: 851
  Description of Artificial Sequence: Synthetic polypeptide
  XENP27628 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1125 - protein, 446 aa, Artificial Sequence
  Description of Artificial Sequence: Synthetic polypeptide
  XENP27628 Chain 2 - mAb B[NKG2D]_H3_IgG1_pI(-)_Isosteric_A _C220S/PVA_/S267K/L368D/K370S-IgG1_PVA_/S267K/S364K/E357Q
EVQLVESGGGLVQPGGSLRLSCAASGYTFTSYWMNWVRQAPGKGLVWVSRIDPYDSETHYNQKVKGRFTISVDKAKSTAYLQMNSLRAEDTAVYYCAKMGDYSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1126 - protein, 214 aa, Artificial Sequence; identical to SEQ ID NO: 1108
  Description of Artificial Sequence: Synthetic polypeptide
  XENP27628 Chain 3 - mAb B[NKG2D]_L1

SEQ ID NO: 1127 - protein, 435 aa, Artificial Sequence; identical to SEQ ID NO: 851
  Description of Artificial Sequence: Synthetic polypeptide
  XENP27629 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1128 - protein, 446 aa, Artificial Sequence; identical to SEQ ID NO: 1125
  Description of Artificial Sequence: Synthetic polypeptide
  XENP27629 Chain 2 - mAb B[NKG2D]_H3__IgG1_pI(-)_Isosteric_A _C220S/PVA_/S267K/L368D/K370S-IgG1_PVA_/S267K/S364K/E357Q

SEQ ID NO: 1129 - protein, 214 aa, Artificial Sequence; identical to SEQ ID NO: 1111
  Description of Artificial Sequence: Synthetic polypeptide
  XENP27629 Chain 3 - mAb B[NKG2D]_L1.1

SEQ ID NO: 1130 - protein, 435 aa, Artificial Sequence; identical to SEQ ID NO: 851
  Description of Artificial Sequence: Synthetic polypeptide
  XENP27630 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1131 - protein, 446 aa, Artificial Sequence; identical to SEQ ID NO: 1125
  Description of Artificial Sequence: Synthetic polypeptide
  XENP27630 Chain 2 - mAb B[NKG2D]_H3_IgG1_pI(-)_Isosteric_A _C220S/PVA_/S267K/L368D/K370S-IgG1_PVA_/S267K/S364K/E357Q

SEQ ID NO: 1132 - protein, 214 aa, Artificial Sequence; identical to SEQ ID NO: 1114
  Description of Artificial Sequence: Synthetic polypeptide
  XENP27630 Chain 3 - mAb B[NKG2D]_L2

SEQ ID NO: 1133 - protein, 435 aa, Artificial Sequence; identical to SEQ ID NO: 851
  Description of Artificial Sequence: Synthetic polypeptide
  XENP27631 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1134 - protein, 449 aa, Artificial Sequence; identical to SEQ ID NO: 1110
  Description of Artificial Sequence: Synthetic polypeptide
  XENP27631 Chain 2 - mAb C[NKG2D]_H1_IgG1_pI(-)_Isosteric_A _C220S/PVA_/S267K/L368D/K370S-IgG1_PVA_/S267K/S364K/E357Q

SEQ ID NO: 1135 - protein, 214 aa, Artificial Sequence
  Description of Artificial Sequence: Synthetic polypeptide
  XENP27631 Chain 3 - mAb C[NKG2D]_L1
DIQLTQSPDFQSVTPKEKVTITCRASQSIGTSIHWYQQKPDQSPKLLIKYASESISGIPSRFSGSGSGTDFTLTINSLEAEDAATYYCQQSNTWPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1136 - protein, 435 aa, Artificial Sequence; identical to SEQ ID NO: 851
  Description of Artificial Sequence: Synthetic polypeptide
  XENP27632 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1137 - protein, 449 aa, Artificial Sequence; identical to SEQ ID NO: 1110
  Description of Artificial Sequence: Synthetic polypeptide
  XENP27632 Chain 2 - mAb C[NKG2D]_H1_IgG1_pI(-)_Isosteric_A _C220S/PVA_/S267K/L368D/K370S-IgG1_PVA_/S267K/S364K/E357Q

SEQ ID NO: 1138 - protein, 214 aa, Artificial Sequence
  Description of Artificial Sequence: Synthetic polypeptide
  XENP27632 Chain 3 - mAb C[NKG2D]_L2
DIQLTQSPSSLSASVGDRVTITCRASQSIGTSIHWYQQKPGKSPKLLIKYASESISGIPSRFSGSGSGTDFTLTISSLQPEDFATYYCQQSNTWPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1139 - protein, 435 aa, Artificial Sequence; identical to SEQ ID NO: 851
  Description of Artificial Sequence: Synthetic polypeptide
  XENP27633 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1140 - protein, 449 aa, Artificial Sequence
  Description of Artificial Sequence: Synthetic polypeptide
  XENP27633 Chain 2 - mAb C[NKG2D]_H2_IgG1_pI(-)_Isosteric_A _C220S/PVA_/S267K/L368D/K370S-IgG1_PVA_/S267K/S364K/E357Q
QVQLVQSGAEVKKPGASVKVSCKVSGFSLTIYGVHWVRQAPGQGLEWMGVIWSGGSTDYNAKFQGRVTMTKDNSKRTVYMELSSLRSEDTAVYYCSRKSHDGYYGVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1141 - protein, 214 aa, Artificial Sequence; identical to SEQ ID NO: 1135
  Description of Artificial Sequence: Synthetic polypeptide
  XENP27633 Chain 3 - mAb C[NKG2D]_L1

SEQ ID NO: 1142 - protein, 435 aa, Artificial Sequence; identical to SEQ ID NO: 851
  Description of Artificial Sequence: Synthetic polypeptide
  XENP27634 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1143 - protein, 449 aa, Artificial Sequence; identical to SEQ ID NO: 1140
  Description of Artificial Sequence: Synthetic polypeptide
  XENP27634 Chain 2 - mAb C[NKG2D]_H2_IgG1_pI(-)_Isosteric_A _C220S/PVA_/S267K/L368D/K370S-IgG1_PVA_/S267K/S364K/E357Q

SEQ ID NO: 1144 - protein, 214 aa, Artificial Sequence; identical to SEQ ID NO: 1138
  Description of Artificial Sequence: Synthetic polypeptide
  XENP27634 Chain 3 - mAb C[NKG2D]_L2

SEQ ID NO: 1145 - protein, 435 aa, Artificial Sequence; identical to SEQ ID NO: 851
  Description of Artificial Sequence: Synthetic polypeptide
  XENP27635 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1146 - protein, 448 aa, Artificial Sequence; identical to SEQ ID NO: 1113
  Description of Artificial Sequence: Synthetic polypeptide
  XENP27635 Chain 2 - mAb A[NKG2D]_H1_IgG1_pI(-)_Isosteric_A _C220S/PVA_/S267K/L368D/K370S-IgG1_PVA_/S267K/S364K/E357Q

SEQ ID NO: 1147 - protein, 213 aa, Artificial Sequence
  Description of Artificial Sequence: Synthetic polypeptide
  XENP27635 Chain 3 - mAb A[NKG2D]_L1
DIQLTQSPSSLSASVGDRVTITCRASSSVSYMHWYQQKPGKSPKPLIYATSNLASGVPARFSGSGSGTDYTLTISSLQPEDFATYYCQQWNSNPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1148 - protein, 435 aa, Artificial Sequence; identical to SEQ ID NO: 851
  Description of Artificial Sequence: Synthetic polypeptide
  XENP27636 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1149 - protein, 448 aa, Artificial Sequence; identical to SEQ ID NO: 1113
  Description of Artificial Sequence: Synthetic polypeptide
  XENP27636 Chain 2 - mAb A[NKG2D]_H1_IgG1_pI(-)_Isosteric_A _C220S/PVA_/S267K/L368D/K370S-IgG1_PVA_/S267K/S364K/E357Q

SEQ ID NO: 1150 - protein, 213 aa, Artificial Sequence
  Description of Artificial Sequence: Synthetic polypeptide
  XENP27636 Chain 3 - mAb A[NKG2D]_L2
DIQLTQSPATLSLSPGERATLSCRASSSVSYMHWYQQKPGQSPRPLIYATSNLASGVPARFSGSGSGTDYTLTISSLEPEDFAVYYCQQWNSNPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1151 - protein, 435 aa, Artificial Sequence; identical to SEQ ID NO: 851
  Description of Artificial Sequence: Synthetic polypeptide
  XENP27637 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1152 - protein, 448 aa, Artificial Sequence
  Description of Artificial Sequence: Synthetic polypeptide
  XENP27637 Chain 2 - mAb A[NKG2D]_H2_IgG1_pI(-)_Isosteric_A _C220S/PVA_/S267K/L368D/K370S-IgG1_PVA_/S267K/S364K/E357Q
QVQLQESGPGLVKPSETLSLTCTVSGFSLTSYGVHWIRQPPGKGLEWIGVIWAGGSTNYNPSLKSRVTISKDNSKSQVSLKLSSVTAADTAVYYCARGGYEGAAWFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1153 - protein, 213 aa, Artificial Sequence; identical to SEQ ID NO: 1147
  Description of Artificial Sequence: Synthetic polypeptide
  XENP27637 Chain 3 - mAb A[NKG2D]_L1

SEQ ID NO: 1154 - protein, 435 aa, Artificial Sequence; identical to SEQ ID NO: 851
  Description of Artificial Sequence: Synthetic polypeptide
  XENP27638 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1155 - protein, 448 aa, Artificial Sequence; identical to SEQ ID NO: 1152
  Description of Artificial Sequence: Synthetic polypeptide
  XENP27638 Chain 2 - mAb A[NKG2D]_H2_IgG1_pI(-)_Isosteric_A _C220S/PVA_/S267K/L368D/K370S-IgG1_PVA_/S267K/S364K/E357Q

SEQ ID NO: 1156 - protein, 213 aa, Artificial Sequence; identical to SEQ ID NO: 1150
  Description of Artificial Sequence: Synthetic polypeptide
  XENP27638 Chain 3 - mAb A[NKG2D]_L2

SEQ ID NO: 1157 - protein, 435 aa, Artificial Sequence; identical to SEQ ID NO: 851
  Description of Artificial Sequence: Synthetic polypeptide
  XENP30592 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S

SEQ ID NO: 1158 - protein, 450 aa, Artificial Sequence
  Description of Artificial Sequence: Synthetic polypeptide
  XENP30592 Chain 2 - 1D7B4[NKG2D]_H1_IgG1_PVA_/S267K/S364K/E357Q
EVQLLESGGGLVQPGGSLRLSCAASGFTFSSYAMSWVRQAPGKGLEWVSSISASGGSTYYADSVKGRFTISRDNSKNTLYLQMNSLRAEDTAVYYCAKGIFSIYFFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1159 - protein, 214 aa, Artificial Sequence; identical to SEQ ID NO: 981
  Description of Artificial Sequence: Synthetic polypeptide
  XENP30592 Chain 3 - 1D7B4[NKG2D]_L1

SEQ ID NO: 1160 - protein, 435 aa, Artificial Sequence; identical to SEQ ID NO: 914
  Description of Artificial Sequence: Synthetic polypeptide
  XENP31077 Chain 1 - human_IL15Ra(sushi)_(GGGGS)5-human _IL15(N4D/N65D;single-chain)_Fc(216)_IgG1_pI(-)_Isosteric_A _C220S/PVA_/S267K/L368D/K370S/M428L/N434S

SEQ ID NO: 1161 - protein, 448 aa, Artificial Sequence
  Description of Artificial Sequence: Synthetic polypeptide
  XENP31077 Chain 2 - mAb A[NKG2D]_H1_IgG1_PVA _/S267K/S364K/E357Q/M428L/N434S
QVQLVQSGAEVKKPGASVKVSCKVSGFSLTSYGVHWIRQAPGQGLEWMGVIWAGGSTNYNSKFQGRVTMTKDNSKSTVYMELSSLRSEDTAVYYCARGGYEGAAWFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1162 - protein, 213 aa, Artificial Sequence; identical to SEQ ID NO: 1147
  Description of Artificial Sequence: Synthetic polypeptide
  XENP31077 Chain 3 - mAb A[NKG2D]_L1

SEQ ID NO: 1163 - protein, 446 aa, Artificial Sequence
  Description of Artificial Sequence: Synthetic polypeptide
  XENP27591 Heavy Chain - 11B2D10[NKG2D]_H0_IgG1_PVA_/S267K
QVQLQQSGPELVRPGASVKLSCKASGYTFTSYWMNWVQQRPEQGLEWIGRIDPYDSETHYNQKFKDKAILTVDKSASTAYMQLSSLTSEDSAVYYCAKMGDYSFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1164 - protein, 214 aa, Artificial Sequence; identical to SEQ ID NO: 1087
  Description of Artificial Sequence: Synthetic polypeptide
  XENP27591 Light Chain - 11B2D10[NKG2D]_L0

SEQ ID NO: 1165 - protein, 449 aa, Artificial Sequence
  Description of Artificial Sequence: Synthetic polypeptide
  XENP27592 Heavy Chain - 6E5A7[NKG2D]_H0_IgG1_PVA_/S267K
QVQLQQSGPGLVQPSQSLSITCTVSGFSLTIYGVHWVRQSPGKGLEWLGVIWSGGSTDYNAAFISRLSISKDNSKRQVFFKMSSLQANDTAIYYCSRKSHDGYYGVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1166 - protein, 214 aa, Artificial Sequence; identical to SEQ ID NO: 1090
  Description of Artificial Sequence: Synthetic polypeptide
  XENP27592 Light Chain - 6E5A7[NKG2D]_L0

SEQ ID NO: 1167 - protein, 448 aa, Artificial Sequence
  Description of Artificial Sequence: Synthetic polypeptide
  XENP27593 Heavy Chain - 6H7E7[NKG2D]_H0_IgG1_PVA_/S267K
QVQLQESGPGLVAPSQSLSITCTVSGFSLTSYGVHWIRQPPGKGLEWLGVIWAGGSTNYNSALMSRLSISKDNSKSQVFLKMNSLQIDDTAMYYCARGGYEGAAWFGYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1168 - protein, 213 aa, Artificial Sequence; identical to SEQ ID NO: 1093
  Description of Artificial Sequence: Synthetic polypeptide
  XENP27593 Light Chain - 6H7E7[NKG2D]_L0

SEQ ID NO: 1169 - protein, 450 aa, Artificial Sequence
  Description of Artificial Sequence: Synthetic polypeptide
  XENP27594 Heavy Chain - mAb E[NKG2D]_H1_IgG1_PVA_/S267K
EVQLVESGGGLVKPGGSLRLSCAASGFTFSSYSMNWVRQAPGKGLEWVSSITSSSSYIYYADSVKGRFTISRDNAKNSLYLQMNSLRAEDTAVYYCARDRRYFDWFPLDYRGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1170 - protein, 215 aa, Artificial Sequence; identical to SEQ ID NO: 1096
  Description of Artificial Sequence: Synthetic polypeptide
  XENP27594 Light Chain - mAb E[NKG2D]_L1

SEQ ID NO: 1171 - protein, 451 aa, Artificial Sequence
  Description of Artificial Sequence: Synthetic polypeptide
  XENP27595 Heavy Chain - 16F31[NKG2D]_H1_IgG1_PVA_/S267K
EVQLVESGGGVVRPGGSLRLSCAASGFTFDDYGMTWVRQAPGKGLEWVSGINWNGGSTGYADSVKGRFTISRDNAKNSLYLQMNSLRAEDTALYYCARERELYYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1172 - protein, 216 aa, Artificial Sequence; identical to SEQ ID NO: 1099
  Description of Artificial Sequence: Synthetic polypeptide
  XENP27595 Light Chain - 16F31[NKG2D]_L1

SEQ ID NO: 1173 - protein, 451 aa, Artificial Sequence
  Description of Artificial Sequence: Synthetic polypeptide
  XENP27596 Heavy Chain - mAb D[NKG2D]_H1_IgG1_PVA_/S267K
QVQLVQSGAEVKKPGASVKVSCKASGYTFTNYWMHWVRQAPGQGLEWMGEIDPSDIYTNYAQKFQGRVTMTRDTSTSTVYMELSSLRSEDTAVYYCARGIYDGYYVYGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1174 - protein, 214 aa, Artificial Sequence; identical to SEQ ID NO: 1102
  Description of Artificial Sequence: Synthetic polypeptide
  XENP27596 Light Chain - mAb D[NKG2D]_L1

SEQ ID NO: 1175 - protein, 447 aa, Artificial Sequence
  Description of Artificial Sequence: Synthetic polypeptide
  XENP27597 Heavy Chain - KYK-1.0[NKG2D]_H1_IgG1_PVA_/S267K
EVQLVESGGGVVQPGGSLRLSCAASGFTFSSYGMHWVRQAPGKGLEWVAFIRYDGSNKYYADSVKGRFTISRDNSKNTKYLQMNSLRAEDTAVYYCAKDRFGYYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1176 - protein, 214 aa, Artificial Sequence; identical to SEQ ID NO: 1105
  Description of Artificial Sequence: Synthetic polypeptide
  XENP27597 Light Chain - KYK-1.0[NKG2D]_L1

SEQ ID NO: 1177 - protein, 446 aa, Artificial Sequence
  Description of Artificial Sequence: Synthetic polypeptide
  XENP27598 Heavy Chain - mAb B[NKG2D]_H1_IgG1_PVA_/S267K
QVQLVQSGAEVKKPGASVKVSCKASGYTFTSYWMNWVRQAPGQGLEWMGRIDPYDSETHYNQKFQGRVTMTVDKSTSTAYMELSSLRSEDTAVYYCAKMGDYSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1178 - protein, 214 aa, Artificial Sequence; identical to SEQ ID NO: 1108
  Description of Artificial Sequence: Synthetic polypeptide
  XENP27598 Light Chain - mAb B[NKG2D]_L1

SEQ ID NO: 1179 - protein, 446 aa, Artificial Sequence; identical to SEQ ID NO: 1177
  Description of Artificial Sequence: Synthetic polypeptide
  XENP27599 Heavy Chain - mAb B[NKG2D]_H1__IgG1_PVA_/S267K

SEQ ID NO: 1180 - protein, 214 aa, Artificial Sequence; identical to SEQ ID NO: 1111
  Description of Artificial Sequence: Synthetic polypeptide
  XENP27599 Light Chain - mAb B[NKG2D]_L1.1

SEQ ID NO: 1181 - protein, 446 aa, Artificial Sequence; identical to SEQ ID NO: 1177
  Description of Artificial Sequence: Synthetic polypeptide
  XENP27600 Heavy Chain - mAb B[NKG2D]_H1_IgG1_PVA_/S267K

SEQ ID NO: 1182 - protein, 214 aa, Artificial Sequence; identical to SEQ ID NO: 1114
  Description of Artificial Sequence: Synthetic polypeptide
  XENP27600 Light Chain - mAb B[NKG2D]_L2

SEQ ID NO: 1183 - protein, 446 aa, Artificial Sequence
  Description of Artificial Sequence: Synthetic polypeptide
  XENP27601 Heavy Chain - mAb B[NKG2D]_H2_IgG1_PVA_/S267K
EVQLVQSGAEVKKPGESLRISCKASGYTFTSYWMNWVRQMPGKGLEWMGRIDPYDSETHYNPSFQGHVTISVDKSISTAYLQWSSLKASDTAMYYCAKMGDYSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1184 - protein, 214 aa, Artificial Sequence; identical to SEQ ID NO: 1108
  Description of Artificial Sequence: Synthetic polypeptide
  XENP27601 Light Chain - mAb B[NKG2D]_L1

SEQ ID NO: 1185 - protein, 446 aa, Artificial Sequence; identical to SEQ ID NO: 1183
  Description of Artificial Sequence: Synthetic polypeptide
  XENP27602 Heavy Chain - mAb B[NKG2D]_H2__IgG1_PVA_/S267K

SEQ ID NO: 1186 - protein, 214 aa, Artificial Sequence; identical to SEQ ID NO: 1111
  Description of Artificial Sequence: Synthetic polypeptide
  XENP27602 Light Chain - mAb B[NKG2D]_L1.1

SEQ ID NO: 1187 - protein, 446 aa, Artificial Sequence; identical to SEQ ID NO: 1183
  Description of Artificial Sequence: Synthetic polypeptide
  XENP27603 Heavy Chain - mAb B[NKG2D]_H2_IgG1_PVA_/S267K

SEQ ID NO: 1188 - protein, 214 aa, Artificial Sequence; identical to SEQ ID NO: 1114
  Description of Artificial Sequence: Synthetic polypeptide
  XENP27603 Light Chain - mAb B[NKG2D]_L2

SEQ ID NO: 1189 - protein, 446 aa, Artificial Sequence
  Description of Artificial Sequence: Synthetic polypeptide
  XENP27604 Heavy Chain - mAb B[NKG2D]_H3_IgG1_PVA_/S267K
EVQLVESGGGLVQPGGSLRLSCAASGYTFTSYWMNWVRQAPGKGLVWVSRIDPYDSETHYNQKVKGRFTISVDKAKSTAYLQMNSLRAEDTAVYYCAKMGDYSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1190 - protein, 214 aa, Artificial Sequence; identical to SEQ ID NO: 1108
  Description of Artificial Sequence: Synthetic polypeptide
  XENP27604 Light Chain - mAb B[NKG2D]_L1

SEQ ID NO: 1191 - protein, 446 aa, Artificial Sequence; identical to SEQ ID NO: 1189
  Description of Artificial Sequence: Synthetic polypeptide
  XENP27605 Heavy Chain - mAb B[NKG2D]_H3__IgG1_PVA_/S267K

SEQ ID NO: 1192 - protein, 214 aa, Artificial Sequence; identical to SEQ ID NO: 1111
  Description of Artificial Sequence: Synthetic polypeptide
  XENP27605 Light Chain - mAb B[NKG2D]_L1.1

SEQ ID NO: 1193 - protein, 446 aa, Artificial Sequence; identical to SEQ ID NO: 1189
  Description of Artificial Sequence: Synthetic polypeptide
  XENP27606 Heavy Chain - mAb B[NKG2D]_H3_IgG1_PVA_/S267K

SEQ ID NO: 1194 - protein, 214 aa, Artificial Sequence; identical to SEQ ID NO: 1114
  Description of Artificial Sequence: Synthetic polypeptide
  XENP27606 Light Chain - mAb B[NKG2D]_L2

SEQ ID NO: 1195 - protein, 449 aa, Artificial Sequence
  Description of Artificial Sequence: Synthetic polypeptide
  XENP27607 Heavy Chain - mAb C[NKG2D]_H1_IgG1_PVA_/S267K
EVQLVESGGGLVQPGGSLRLSCAVSGFSLTIYGVHWVRQAPGKGLEWVSVIWSGGSTDYNAKVKGRFTISKDNSKRTVYLQMNSLRAEDTAVYYCSRKSHDGYYGVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1196 - protein, 214 aa, Artificial Sequence; identical to SEQ ID NO: 1135
  Description of Artificial Sequence: Synthetic polypeptide
  XENP27607 Light Chain - mAb C[NKG2D]_L1

SEQ ID NO: 1197 - protein, 449 aa, Artificial Sequence; identical to SEQ ID NO: 1195
  Description of Artificial Sequence: Synthetic polypeptide
  XENP27608 Heavy Chain - mAb C[NKG2D]_H1_IgG1_PVA_/S267K

SEQ ID NO: 1198 - protein, 214 aa, Artificial Sequence; identical to SEQ ID NO: 1138
  Description of Artificial Sequence: Synthetic polypeptide
  XENP27608 Light Chain - mAb C[NKG2D]_L2

SEQ ID NO: 1199 - protein, 449 aa, Artificial Sequence
  Description of Artificial Sequence: Synthetic polypeptide
  XENP27609 Heavy Chain - mAb C[NKG2D]_H2_IgG1_PVA_/S267K
QVQLVQSGAEVKKPGASVKVSCKVSGFSLTIYGVHWVRQAPGQGLEWMGVIWSGGSTDYNAKFQGRVTMTKDNSKRTVYMELSSLRSEDTAVYYCSRKSHDGYYGVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1200 - protein, 214 aa, Artificial Sequence; identical to SEQ ID NO: 1135
  Description of Artificial Sequence: Synthetic polypeptide
  XENP27609 Light Chain - mAb C[NKG2D]_L1

SEQ ID NO: 1201 - protein, 449 aa, Artificial Sequence; identical to SEQ ID NO: 1199
  Description of Artificial Sequence: Synthetic polypeptide
  XENP27610 Heavy Chain - mAb C[NKG2D]_H2_IgG1_PVA_/S267K

SEQ ID NO: 1202 - protein, 214 aa, Artificial Sequence; identical to SEQ ID NO: 1138
  Description of Artificial Sequence: Synthetic polypeptide
  XENP27610 Light Chain - mAb C[NKG2D]_L2

SEQ ID NO: 1203 - protein, 448 aa, Artificial Sequence
  Description of Artificial Sequence: Synthetic polypeptide
  XENP27611 Heavy Chain - mAb A[NKG2D]_H1_IgG1_PVA_/S267K
QVQLVQSGAEVKKPGASVKVSCKVSGFSLTSYGVHWIRQAPGQGLEWMGVIWAGGSTNYNSKFQGRVTMTKDNSKSTVYMELSSLRSEDTAVYYCARGGYEGAAWFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1204 - protein, 213 aa, Artificial Sequence; identical to SEQ ID NO: 1147
  Description of Artificial Sequence: Synthetic polypeptide
  XENP27611 Light Chain - mAb A[NKG2D]_L1

SEQ ID NO: 1205 - protein, 448 aa, Artificial Sequence; identical to SEQ ID NO: 1203
  Description of Artificial Sequence: Synthetic polypeptide
  XENP27612 Heavy Chain - mAb A[NKG2D]_H1_IgG1_PVA_/S267K

SEQ ID NO: 1206 - protein, 213 aa, Artificial Sequence; identical to SEQ ID NO: 1150
  Description of Artificial Sequence: Synthetic polypeptide
  XENP27612 Light Chain - mAb A[NKG2D]_L2

SEQ ID NO: 1207 - protein, 448 aa, Artificial Sequence
  Description of Artificial Sequence: Synthetic polypeptide
  XENP27613 Heavy Chain - mAb A[NKG2D]_H2_IgG1_PVA_/S267K
QVQLQESGPGLVKPSETLSLTCTVSGFSLTSYGVHWIRQPPGKGLEWIGVIWAGGSTNYNPSLKSRVTISKDNSKSQVSLKLSSVTAADTAVYYCARGGYEGAAWFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1208 - protein, 213 aa, Artificial Sequence; identical to SEQ ID NO: 1147
  Description of Artificial Sequence: Synthetic polypeptide
  XENP27613 Light Chain - mAb A[NKG2D]_L1

SEQ ID NO: 1209 - protein, 448 aa, Artificial Sequence; identical to SEQ ID NO: 1207
  Description of Artificial Sequence: Synthetic polypeptide
  XENP27614 Heavy Chain - mAb A[NKG2D]_H2_IgG1_PVA_/S267K

SEQ ID NO: 1210 - protein, 213 aa, Artificial Sequence; identical to SEQ ID NO: 1150
  Description of Artificial Sequence: Synthetic polypeptide
  XENP27614 Light Chain - mAb A[NKG2D]_L2

SEQ ID NO: 1211 - protein, 435 aa, Artificial Sequence; identical to SEQ ID NO: 859
  Description of Artificial Sequence: Synthetic polypeptide
  XENP21993 Chain 1 - human_IL15Ra(sushi)_(GGGGS)5-human _IL15(single-Chain)_Fc(216)_IgG1_pI(-)_Isosteric_A_C220S/PVA _/S267K/L368D/K370S

SEQ ID NO: 1212 - protein, 231 aa, Artificial Sequence; identical to SEQ ID NO: 43
  Description of Artificial Sequence: Synthetic polypeptide
  XENP21993 Chain 2 - empty-Fc(216)_IgG1_C220S/PVA _/S267K/S364K/E357Q

SEQ ID NO: 1213 - protein, 350 aa, Artificial Sequence
  Description of Artificial Sequence: Synthetic polypeptide
  XENP22853 Chain 1 - human_IL15_(GGGGS)1-Fc(216)_IgG1_pI(-) _Isosteric_A_C220S/PVA_/S267K/L368D/K370S/M428L/N434S
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1214 - protein, 301 aa, Artificial Sequence; identical to SEQ ID NO: 891
  Description of Artificial Sequence: Synthetic polypeptide
  XENP22853 Chain 2 - human_IL15Ra(Sushi)_(GGGGS)1-Fc(216)_IgG1 _C220S/PVA_/S267K/S364K/E357Q/M428L/N434S

SEQ ID NO: 1215 - protein, 435 aa, Artificial Sequence; identical to SEQ ID NO: 851
  Description of Artificial Sequence: Synthetic polypeptide
  XENP24050 Chain 1 - human_IL15Ra(sushi)_(GGGGS)5-human_IL15 _N4D/N65D_(single-Chain)-Fc(216)_IgG1_pI(-)_Isosteric_A _C220S/PVA_/S267K/L368D/K370S

SEQ ID NO: 1216 - protein, 231 aa, Artificial Sequence; identical to SEQ ID NO: 43
  Description of Artificial Sequence: Synthetic polypeptide
  XENP24050 Chain 2 - empty-Fc(216)_IgG1_C220S/PVA _/S267K/S364K/E357Q

SEQ ID NO: 1217 - protein, 350 aa, Artificial Sequence
  Description of Artificial Sequence: Synthetic polypeptide
  XENP24113 Chain 1 - human_IL15_N4D/N65D_(GGGGS)1-Fc(216)_IgG1 _pI(-)_Isosteric_A_C220S/PVA_/S267K/L368D/K370S/M428L/N434S
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1218 - protein, 301 aa, Artificial Sequence; identical to SEQ ID NO: 891
  Description of Artificial Sequence: Synthetic polypeptide
  XENP24113 Chain 2 - human_IL15Ra(Sushi)_(GGGGS)1-Fc(216)_IgG1 _C220S/PVA_/S267K/S364K/E357Q/M428L/N434S

SEQ ID NO: 1219 - protein, 435 aa, Artificial Sequence; identical to SEQ ID NO: 914
  Description of Artificial Sequence: Synthetic polypeptide
  XENP24294 Chain 1 - human_IL15Ra(sushi)_(GGGGS)5-human_IL15 _N4D/N65D_(single-Chain)-Fc(216)_IgG1_pI(-)_Isosteric_A _C220S/PVA_/S267K/L368D/K370S/M428L/N434S

SEQ ID NO: 1220 - protein, 231 aa, Artificial Sequence; identical to SEQ ID NO: 63
  Description of Artificial Sequence: Synthetic polypeptide
  XENP24294 Chain 2 - empty-Fc(216)_IgG1_C220S/PVA _/S267K/S364K/E357Q/M428L/N434S

SEQ ID NO: 1221 - protein, 350 aa, Artificial Sequence; identical to SEQ ID NO: 908
  Description of Artificial Sequence: Synthetic polypeptide
  XENP24306 Chain 1 - human_IL15_D30N/E64Q/N65D_(GGGGS)1-Fc(216) _IgG1_pI(-)_Isosteric_A_C220S/PVA_/S267K/L368D/K370S/M428L/N434S

SEQ ID NO: 1222 - protein, 301 aa, Artificial Sequence; identical to SEQ ID NO: 891
  Description of Artificial Sequence: Synthetic polypeptide
  XENP24306 Chain 2 - human_IL15Ra(Sushi)_(GGGGS)1-Fc(216)_IgG1 _C220S/PVA_/S267K/S364K/E357Q/M428L/N434S

SEQ ID NO: 1223 - protein, 114 aa, Artificial Sequence; identical to SEQ ID NO: 273
  Description of Artificial Sequence: Synthetic polypeptide
  D30N

SEQ ID NO: 1224 - protein, 114 aa, Artificial Sequence
  Description of Artificial Sequence: Synthetic polypeptide
  N1D/D30N
DWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTS

SEQ ID NO: 1225 - protein, 114 aa, Artificial Sequence
  Description of Artificial Sequence: Synthetic polypeptide
  N4D/D30N
NWVDVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTS

SEQ ID NO: 1226 - protein, 114 aa, Artificial Sequence
  Description of Artificial Sequence: Synthetic polypeptide
  D30N/E64Q
NWVNVISDLKKIEDLIQSMHIDATLYTESNVHPSCKVTAMKCFLLELQVISLESGDASIHDTVQNLIILANNSLSSNGNVTESGCKECEELEEKNIKEFLQSFVHIVQMFINTS

SEQ ID NO: 1227 - protein, 114 aa, Artificial Sequence; identical to SEQ ID NO: 293
  Description of Artificial Sequence: Synthetic polypeptide
  D30N/N65D

SEQ ID NO: 1228 - protein, 114 aa, Artificial Sequence; identical to SEQ ID NO: 298
  Description of Artificial Sequence: Synthetic polypeptide
  D30N/E64Q/N65D

SEQ ID NO: 1229 - protein, 435 aa, Artificial Sequence
  Description of Artificial Sequence: Synthetic polypeptide
  XENP29281 Chain 1 - human_IL15Ra(sushi)_(GGGGS)5-human_IL15 _D30N_(single-Chain)-Fc(216)_IgG1_pI(-)_Isosteric_A_C220S/PVA _/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1230 - protein, 231 aa, Artificial Sequence; identical to SEQ ID NO: 43
  Description of Artificial Sequence: Synthetic polypeptide
  XENP29281 Chain 2 - empty-Fc(216)_IgG1_C220S/PVA _/S267K/S364K/E357Q

SEQ ID NO: 1231 - protein, 435 aa, Artificial Sequence
  Description of Artificial Sequence: Synthetic polypeptide
  XENP29282 Chain 1 - human_IL15Ra(sushi)_(GGGGS)5-human_IL15 _N1D/D30N_(single-Chain)-Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSDWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1232 - protein, 231 aa, Artificial Sequence; identical to SEQ ID NO: 43
  Description of Artificial Sequence: Synthetic polypeptide
  XENP29282 Chain 2 - empty-Fc(216)_IgG1_C220S/PVA _/S267K/S364K/E357Q

SEQ ID NO: 1233 - protein, 435 aa, Artificial Sequence
  Description of Artificial Sequence: Synthetic polypeptide
  XENP29283 Chain 1 - human_IL15Ra(sushi)_(GGGGS)5-human_IL15 _N4D/D30N_(single-Chain)-Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1234 - protein, 231 aa, Artificial Sequence; identical to SEQ ID NO: 43
  Description of Artificial Sequence: Synthetic polypeptide
  XENP29283 Chain 2 - empty-Fc(216)_IgG1_C220S/PVA _/S267K/S364K/E357Q

SEQ ID NO: 1235 - protein, 435 aa, Artificial Sequence
  Description of Artificial Sequence: Synthetic polypeptide
  XENP29284 Chain 1 - human_IL15Ra(sushi)_(GGGGS)5-human_IL15 _D30N/E64Q_(single-Chain)-Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVQNLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1236 - protein, 231 aa, Artificial Sequence; identical to SEQ ID NO: 43
  Description of Artificial Sequence: Synthetic polypeptide
  XENP29284 Chain 2 - empty-Fc(216)_IgG1_C220S/PVA _/S267K/S364K/E357Q

SEQ ID NO: 1237 - protein, 435 aa, Artificial Sequence
  Description of Artificial Sequence: Synthetic polypeptide
  XENP29285 Chain 1 - human_IL15Ra(sushi)_(GGGGS)5-human_IL15 _D30N/N65D_(single-Chain)-Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1238 - protein, 231 aa, Artificial Sequence; identical to SEQ ID NO: 43
  Description of Artificial Sequence: Synthetic polypeptide
  XENP29285 Chain 2 - empty-Fc(216)_IgG1_C220S/PVA _/S267K/S364K/E357Q

SEQ ID NO: 1239 - protein, 435 aa, Artificial Sequence
  Description of Artificial Sequence: Synthetic polypeptide
  XENP29286 Chain 1 - human_IL15Ra(sushi)_(GGGGS)5-human_IL15 _D30N/E64Q/N65D_(single-Chain)-Fc(216)_IgG1_pI(-)_Isosteric_A _C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 1240 - protein, 231 aa, Artificial Sequence; identical to SEQ ID NO: 43
  Description of Artificial Sequence: Synthetic polypeptide
  XENP29286 Chain 2 - empty-Fc(216)_IgG1_pI(-)_Isosteric_A _C220S/PVA_/S267K/L368D/K370S

SEQ ID NO: 1241 - protein, 435 aa, Artificial Sequence; identical to SEQ ID NO: 1237
  Description of Artificial Sequence: Synthetic polypeptide
  XENP30453 Chain 1 - human_IL15Ra(sushi)_(GGGGS)5-human _IL15(D30N/N65D;single-chain)_Fc(216)_IgG1_pI(-)_Isosteric_A _C220S/PVA_/S267K/L368D/K370S

SEQ ID NO: 1242 - protein, 444 aa, Artificial Sequence; identical to SEQ ID NO: 943
  Description of Artificial Sequence: Synthetic polypeptide
  XENP30453 Chain 2 - MS[NKG2D]_H0_IgG1_pI(-)_Isosteric_A _C220S/PVA_/S267K/L368D/K370S-IgG1_PVA_/S267K/S364K/E357Q

SEQ ID NO: 1243 - protein, 215 aa, Artificial Sequence; identical to SEQ ID NO: 932
  Description of Artificial Sequence: Synthetic polypeptide
  XENP30453 Chain 3 - MS[NKG2D]_L0

SEQ ID NO: 1244 - protein, 435 aa, Artificial Sequence; identical to SEQ ID NO: 1237
  Description of Artificial Sequence: Synthetic polypeptide
  XENP30593 Chain 1 - human_IL15Ra(sushi)_(GGGGS)5-human _IL15(D30N/N65D;single-chain)_Fc(216)_IgG1_pI(-)_Isosteric_A _C220S/PVA_/S267K/L368D/K370S

SEQ ID NO: 1245 - protein, 450 aa, Artificial Sequence; identical to SEQ ID NO: 1158
  Description of Artificial Sequence: Synthetic polypeptide
  XENP30593 Chain 2 - 1D7B4[NKG2D]_H1_IgG1_PVA_/S267K/S364K/E357Q

SEQ ID NO: 1246 - protein, 214 aa, Artificial Sequence; identical to SEQ ID NO: 981
  Description of Artificial Sequence: Synthetic polypeptide
  XENP30593 Chain 3 - 1D7B4[NKG2D]_L1

SEQ ID NO: 1247 - protein, 435 aa, Artificial Sequence; identical to SEQ ID NO: 1237
  Description of Artificial Sequence: Synthetic polypeptide
  XENP30595 Chain 1 - human_IL15Ra(sushi)_(GGGGS)5-human _IL15(D30N/N65D;single-chain)_Fc(216)_IgG1_pI(-)_Isosteric_A _C220S/PVA_/S267K/L368D/K370S

SEQ ID NO: 1248 - protein, 448 aa, Artificial Sequence; identical to SEQ ID NO: 1113
  Description of Artificial Sequence: Synthetic polypeptide
  XENP30595 Chain 2 - mAb A[NKG2D]_H1_IgG1_PVA_/S267K/S364K/E357Q

SEQ ID NO: 1249 - protein, 213 aa, Artificial Sequence; identical to SEQ ID NO: 1147
  Description of Artificial Sequence: Synthetic polypeptide
  XENP30595 Chain 3 - mAb A[NKG2D]_L1

SEQ ID NO: 1250 - protein, 435 aa, Artificial Sequence
  Description of Artificial Sequence: Synthetic polypeptide
  XENP31078 Chain 1 - human_IL15Ra(sushi)_(GGGGS)5-human _IL15(D30N/N65 D;single-chain)_Fc(216)_IgG1_pI(-)_Isosteric_A _C220S/PVA_/S267K/L368D/K370S/M428L/N434S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1251 - protein, 448 aa, Artificial Sequence; identical to SEQ ID NO: 1161
  Description of Artificial Sequence: Synthetic polypeptide
  XENP31078 Chain 2 - mAb A[NKG2D]_H1_IgG1_PVA _/S267K/S364K/E357Q/M428L/N434S

SEQ ID NO: 1252 - protein, 213 aa, Artificial Sequence; identical to SEQ ID NO: 1147
  Description of Artificial Sequence: Synthetic polypeptide
  XENP31078 Chain 3 - mAb A[NKG2D]_L1

SEQ ID NO: 1253 - protein, 435 aa, Artificial Sequence; identical to SEQ ID NO: 1250
  Description of Artificial Sequence: Synthetic polypeptide
  XENP31080 Chain 1 - human_IL15Ra(sushi)_(GGGGS)5-human _IL15(D30N/N65D;single-chain)_Fc(216)_IgG1_pI(-)_Isosteric_A _C220S/PVA_/S267K/L368D/K370S/M428L/N434S

SEQ ID NO: 1254 - protein, 450 aa, Artificial Sequence; identical to SEQ ID NO: 1083
  Description of Artificial Sequence: Synthetic polypeptide
  XENP31080 Chain 2 - 1D7B4[NKG2D]_H1_IgG1_PVA _/S267K/S364K/E357Q/M428L/N434S

SEQ ID NO: 1255 - protein, 214 aa, Artificial Sequence; identical to SEQ ID NO: 981
  Description of Artificial Sequence: Synthetic polypeptide
  XENP31080 Chain 3 - 1D7B4[NKG2D]_L1

SEQ ID NO: 1256 - protein, 435 aa, Artificial Sequence; identical to SEQ ID NO: 1239
  Description of Artificial Sequence: Synthetic polypeptide
  XENP30594 Chain 1 - human_IL15Ra(sushi)_(GGGGS)5-human _IL15(D30N/E64Q/N65D;single-chain)_Fc(216)_IgG1_pI(-)_Isosteric _A_C220S/PVA_/S267K/L368D/K370S

SEQ ID NO: 1257 - protein, 450 aa, Artificial Sequence; identical to SEQ ID NO: 1158
  Description of Artificial Sequence: Synthetic polypeptide
  XENP30594 Chain 2 - 1D7B4[NKG2D]_H1_IgG1_PVA_/S267K/S364K/E357Q

SEQ ID NO: 1258 - protein, 214 aa, Artificial Sequence; identical to SEQ ID NO: 981
  Description of Artificial Sequence: Synthetic polypeptide
  XENP30594 Chain 3 - 1D7B4[NKG2D]_L1

SEQ ID NO: 1259 - protein, 435 aa, Artificial Sequence; identical to SEQ ID NO: 1239
  Description of Artificial Sequence: Synthetic polypeptide
  XENP30596 Chain 1 - human_IL15Ra(sushi)_(GGGGS)5-human _IL15(D30N/E64Q/N65D;single-chain)_Fc(216)_IgG1_pI(-)_Isosteric _A_C220S/PVA_/S267K/L368D/K370S

SEQ ID NO: 1260 - protein, 448 aa, Artificial Sequence; identical to SEQ ID NO: 1113
  Description of Artificial Sequence: Synthetic polypeptide
  XENP30596 Chain 2 - mAb A[NKG2D]_H1_IgG1_PVA_/S267K/S364K/E357Q

SEQ ID NO: 1261 - protein, 213 aa, Artificial Sequence; identical to SEQ ID NO: 1147
  Description of Artificial Sequence: Synthetic polypeptide
  XENP30596 Chain 3 - mAb A[NKG2D]_L1

SEQ ID NO: 1262 - protein, 435 aa, Artificial Sequence
  Description of Artificial Sequence: Synthetic polypeptide
  XENP31079 Chain 1 - human_IL15Ra(sushi)_(GGGGS)5-human _IL15(D30N/E64Q/N65D;single-chain)_Fc(216)_IgG1_pI(-)_Isosteric _A_C220S/PVA_/S267K/L368D/K370S/M428L/N434S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1263 - protein, 448 aa, Artificial Sequence; identical to SEQ ID NO: 1161
  Description of Artificial Sequence: Synthetic polypeptide
  XENP31079 Chain 2 - mAb A[NKG2D]_H1_IgG1_PVA _/S267K/S364K/E357Q/M428L/N434S

SEQ ID NO: 1264 - protein, 213 aa, Artificial Sequence; identical to SEQ ID NO: 1147
  Description of Artificial Sequence: Synthetic polypeptide
  XENP31079 Chain 3 - mAb A[NKG2D]_L1

SEQ ID NO: 1265 - protein, 435 aa, Artificial Sequence; identical to SEQ ID NO: 1262
  Description of Artificial Sequence: Synthetic polypeptide
  XENP31081 Chain 1 - human_IL15Ra(sushi)_(GGGGS)5-human _IL15(D30N/E64Q/N65D;single-chain)_Fc(216)_IgG1_pI(-)_Isosteric _A_C220S/PVA_/S267K/L368D/K370S/M428L/N434S

SEQ ID NO: 1266 - protein, 450 aa, Artificial Sequence; identical to SEQ ID NO: 1083
  Description of Artificial Sequence: Synthetic polypeptide
  XENP31081 Chain 2 - 1D7B4[NKG2D]_H1_IgG1_PVA _/S267K/S364K/E357Q/M428L/N434S

SEQ ID NO: 1267 - protein, 214 aa, Artificial Sequence; identical to SEQ ID NO: 981
  Description of Artificial Sequence: Synthetic polypeptide
  XENP31081 Chain 3 - 1D7B4[NKG2D]_L1

SEQ ID NO: 1268 - protein, 435 aa, Artificial Sequence; identical to SEQ ID NO: 1262
  Description of Artificial Sequence: Synthetic polypeptide
  XENP33332 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S/M428L/N434S

SEQ ID NO: 1269 - protein, 444 aa, Artificial Sequence
  Description of Artificial Sequence: Synthetic polypeptide
  XENP33332 Chain 2 - MS[NKG2D]_H0_IgG1_PVA _/S267K/S364K/E357Q/M428L/N434S
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1270 - protein, 215 aa, Artificial Sequence; identical to SEQ ID NO: 932
  Description of Artificial Sequence: Synthetic polypeptide
  XENP33332 Chain 3- MS[NKG2D]_L0

SEQ ID NO: 1271 - protein, 435 aa, Artificial Sequence; identical to SEQ ID NO: 1262
  Description of Artificial Sequence: Synthetic polypeptide
  XENP33334 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S/M428L/N434S

SEQ ID NO: 1272 - protein, 449 aa, Artificial Sequence
  Description of Artificial Sequence: Synthetic polypeptide
  XENP33334 Chain 2 - mAb C[NKG2D]_H2_IgG1_PVA _/S267K/S364K/E357Q/M428L/N434S
EVQLVESGGGLVQPGGSLRLSCAVSGFSLTIYGVHWVRQAPGKGLEWVSVIWSGGSTDYNAKVKGRFTISKDNSKRTVYLQMNSLRAEDTAVYYCSRKSHDGYYGVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1273 - protein, 214 aa, Artificial Sequence; identical to SEQ ID NO: 1135
  Description of Artificial Sequence: Synthetic polypeptide
  XENP33334 Chain 3- mAb C[NKG2D]_L1

SEQ ID NO: 1274 - protein, 435 aa, Artificial Sequence; identical to SEQ ID NO: 1262
  Description of Artificial Sequence: Synthetic polypeptide
  XENP33336 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S/M428L/N434S

SEQ ID NO: 1275 - protein, 450 aa, Artificial Sequence
  Description of Artificial Sequence: Synthetic polypeptide
  XENP33336 Chain 2 - mAb E[NKG2D]_H1_IgG1_PVA _/S267K/S364K/E357Q/M428L/N434S
EVQLVESGGGLVKPGGSLRLSCAASGFTFSSYSMNWVRQAPGKGLEWVSSITSSSSYIYYADSVKGRFTISRDNAKNSLYLQMNSLRAEDTAVYYCARDRRYFDWFPLDYRGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1276 - protein, 215 aa, Artificial Sequence; identical to SEQ ID NO: 1096
  Description of Artificial Sequence: Synthetic polypeptide
  XENP33336 Chain 3- mAb E[NKG2D]_L1

SEQ ID NO: 1277 - protein, 435 aa, Artificial Sequence; identical to SEQ ID NO: 1262
  Description of Artificial Sequence: Synthetic polypeptide
  XENP33338 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S/M428L/N434S

SEQ ID NO: 1278 - protein, 451 aa, Artificial Sequence
  Description of Artificial Sequence: Synthetic polypeptide
  XENP33338 Chain 2 - 16F31[NKG2D]_H1_IgG1_PVA _/S267K/S364K/E357Q/M428L/N434S
EVQLVESGGGVVRPGGSLRLSCAASGFTFDDYGMTWVRQAPGKGLEWVSGINWNGGSTGYADSVKGRFTISRDNAKNSLYLQMNSLRAEDTALYYCARERELYYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1279 - protein, 216 aa, Artificial Sequence; identical to SEQ ID NO: 1099
  Description of Artificial Sequence: Synthetic polypeptide
  XENP33338 Chain 3- 16F31[NKG2D]_L1

SEQ ID NO: 1280 - protein, 435 aa, Artificial Sequence; identical to SEQ ID NO: 1262
  Description of Artificial Sequence: Synthetic polypeptide
  XENP33340 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S/M428L/N434S

SEQ ID NO: 1281 - protein, 447 aa, Artificial Sequence
  Description of Artificial Sequence: Synthetic polypeptide
  XENP33340 Chain 2 - KYK-1.0[NKG2D]_H1_IgG1_PVA _/S267K/S364K/E357Q/M428L/N434S
EVQLVESGGGVVQPGGSLRLSCAASGFTFSSYGMHWVRQAPGKGLEWVAFIRYDGSNKYYADSVKGRFTISRDNSKNTKYLQMNSLRAEDTAVYYCAKDRFGYYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1282 - protein, 214 aa, Artificial Sequence; identical to SEQ ID NO: 1105
  Description of Artificial Sequence: Synthetic polypeptide
  XENP33340 Chain 3- KYK-1.0[NKG2D]_L1

SEQ ID NO: 1283 - protein, 435 aa, Artificial Sequence; identical to SEQ ID NO: 1262
  Description of Artificial Sequence: Synthetic polypeptide
  XENP33342 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S/M428L/N434S

SEQ ID NO: 1284 - protein, 450 aa, Artificial Sequence
  Description of Artificial Sequence: Synthetic polypeptide
  XENP33342 Chain 2 - KYK-2.0[NKG2D]_H0_IgG1_PVA _/S267K/S364K/E357Q/M428L/N434S
QVQLVESGGGLVKPGGSLRLSCAASGFTFSSYGMHWVRQAPGKGLEWVAFIRYDGSNKYYADSVKGRFTISRDNSKNTKYLQMNSLRAEDTAVYYCAKDRGLGDGTYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1285 - protein, 216 aa, Artificial Sequence; identical to SEQ ID NO: 1081
  Description of Artificial Sequence: Synthetic polypeptide
  XENP33342 Chain 3- KYK-2.0[NKG2D]_L1

SEQ ID NO: 1286 - protein, 435 aa, Artificial Sequence; identical to SEQ ID NO: 1262
  Description of Artificial Sequence: Synthetic polypeptide
  XENP33344 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S/M428L/N434S

SEQ ID NO: 1287 - protein, 446 aa, Artificial Sequence
  Description of Artificial Sequence: Synthetic polypeptide
  XENP33344 Chain 2 - mAb B[NKG2D]_H1_IgG1_PVA _/S267K/S364K/E357Q/M428L/N434S
QVQLVQSGAEVKKPGASVKVSCKASGYTFTSYWMNWVRQAPGQGLEWMGRIDPYDSETHYNQKFQGRVTMTVDKSTSTAYMELSSLRSEDTAVYYCAKMGDYSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1288 - protein, 214 aa, Artificial Sequence; identical to SEQ ID NO: 1108
  Description of Artificial Sequence: Synthetic polypeptide
  XENP33344 Chain 3- mAb B[NKG2D]_L1

SEQ ID NO: 1289 - protein, 435 aa, Artificial Sequence; identical to SEQ ID NO: 1262
  Description of Artificial Sequence: Synthetic polypeptide
  XENP33346 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S/M428L/N434S

SEQ ID NO: 1290 - protein, 451 aa, Artificial Sequence
  Description of Artificial Sequence: Synthetic polypeptide
  XENP33346 Chain 2 - mAb D[NKG2D]_H1_IgG1_PVA _/S267K/S364K/E357Q/M428L/N434S
QVQLVQSGAEVKKPGASVKVSCKASGYTFTNYWMHWVRQAPGQGLEWMGEIDPSDIYTNYAQKFQGRVTMTRDTSTSTVYMELSSLRSEDTAVYYCARGIYDGYYVYGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1291 - protein, 214 aa, Artificial Sequence; identical to SEQ ID NO: 1102
  Description of Artificial Sequence: Synthetic polypeptide
  XENP33346 Chain 3- mAb D[NKG2D]_L1

SEQ ID NO: 1292 - protein, 435 aa, Artificial Sequence; identical to SEQ ID NO: 1239
  Description of Artificial Sequence: Synthetic polypeptide
  XENP33350 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S

SEQ ID NO: 1293 - protein, 444 aa, Artificial Sequence; identical to SEQ ID NO: 943
  Description of Artificial Sequence: Synthetic polypeptide
  XENP33350 Chain 2 - MS[NKG2D]_H0_IgG1_PVA_/S267K/S364K/E357Q

SEQ ID NO: 1294 - protein, 215 aa, Artificial Sequence; identical to SEQ ID NO: 932
  Description of Artificial Sequence: Synthetic polypeptide
  XENP33350 Chain 3- MS[NKG2D]_L0

SEQ ID NO: 1295 - protein, 435 aa, Artificial Sequence; identical to SEQ ID NO: 1239
  Description of Artificial Sequence: Synthetic polypeptide
  XENP33352 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S

SEQ ID NO: 1296 - protein, 449 aa, Artificial Sequence; identical to SEQ ID NO: 1110
  Description of Artificial Sequence: Synthetic polypeptide
  XENP33352 Chain 2 - mAb C[NKG2D]_H2_IgG1_PVA_/S267K/S364K/E357Q

SEQ ID NO: 1297 - protein, 214 aa, Artificial Sequence; identical to SEQ ID NO: 1135
  Description of Artificial Sequence: Synthetic polypeptide
  XENP33352 Chain 3- mAb C[NKG2D]_L1

SEQ ID NO: 1298 - protein, 435 aa, Artificial Sequence; identical to SEQ ID NO: 1239
  Description of Artificial Sequence: Synthetic polypeptide
  XENP33354 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S

SEQ ID NO: 1299 - protein, 450 aa, Artificial Sequence; identical to SEQ ID NO: 1095
  Description of Artificial Sequence: Synthetic polypeptide
  XENP33354 Chain 2 - mAb E[NKG2D]_H1_IgG1_PVA_/S267K/S364K/E357Q

SEQ ID NO: 1300 - protein, 215 aa, Artificial Sequence; identical to SEQ ID NO: 1096
  Description of Artificial Sequence: Synthetic polypeptide
  XENP33354 Chain 3- mAb E[NKG2D]_L1

SEQ ID NO: 1301 - protein, 435 aa, Artificial Sequence; identical to SEQ ID NO: 1239
  Description of Artificial Sequence: Synthetic polypeptide
  XENP33356 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S

SEQ ID NO: 1302 - protein, 451 aa, Artificial Sequence; identical to SEQ ID NO: 1098
  Description of Artificial Sequence: Synthetic polypeptide
  XENP33356 Chain 2 - 16F31[NKG2D]_H1_IgG1_PVA_/S267K/S364K/E357Q

SEQ ID NO: 1303 - protein, 216 aa, Artificial Sequence; identical to SEQ ID NO: 1099
  Description of Artificial Sequence: Synthetic polypeptide
  XENP33356 Chain 3- 16F31[NKG2D]_L1

SEQ ID NO: 1304 - protein, 435 aa, Artificial Sequence; identical to SEQ ID NO: 1239
  Description of Artificial Sequence: Synthetic polypeptide
  XENP33358 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S

SEQ ID NO: 1305 - protein, 447 aa, Artificial Sequence; identical to SEQ ID NO: 1104
  Description of Artificial Sequence: Synthetic polypeptide
  XENP33358 Chain 2 - KYK-1.0[NKG2D]_H1_IgG1_PVA _/S267K/S364K/E357Q

SEQ ID NO: 1306 - protein, 214 aa, Artificial Sequence; identical to SEQ ID NO: 1105
  Description of Artificial Sequence: Synthetic polypeptide
  XENP33358 Chain 3- KYK-1.0[NKG2D]_L1

SEQ ID NO: 1307 - protein, 435 aa, Artificial Sequence; identical to SEQ ID NO: 1239
  Description of Artificial Sequence: Synthetic polypeptide
  XENP33360 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S

SEQ ID NO: 1308 - protein, 450 aa, Artificial Sequence; identical to SEQ ID NO: 1080
  Description of Artificial Sequence: Synthetic polypeptide
  XENP33360 Chain 2 - KYK-2.0[NKG2D]_H0_IgG1_PVA _/S267K/S364K/E357Q

SEQ ID NO: 1309 - protein, 216 aa, Artificial Sequence; identical to SEQ ID NO: 1081
  Description of Artificial Sequence: Synthetic polypeptide
  XENP33360 Chain 3- KYK-2.0[NKG2D]_L1

SEQ ID NO: 1310 - protein, 435 aa, Artificial Sequence; identical to SEQ ID NO: 1239
  Description of Artificial Sequence: Synthetic polypeptide
  XENP33362 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S

SEQ ID NO: 1311 - protein, 446 aa, Artificial Sequence; identical to SEQ ID NO: 1107
  Description of Artificial Sequence: Synthetic polypeptide
  XENP33362 Chain 2 - mAb B[NKG2D]_H1_IgG1_PVA_/S267K/S364K/E357Q

SEQ ID NO: 1312 - protein, 214 aa, Artificial Sequence; identical to SEQ ID NO: 1108
  Description of Artificial Sequence: Synthetic polypeptide
  XENP33362 Chain 3- mAb B[NKG2D]_L1

SEQ ID NO: 1313 - protein, 435 aa, Artificial Sequence; identical to SEQ ID NO: 1239
  Description of Artificial Sequence: Synthetic polypeptide
  XENP33364 Chain 1 - human_IL15Ra(sushi)_(GGGGS)5-human _IL15(D30N/E64Q/N65D;single-chain)_IgG1_pI(-)_Isosteric_A _C220S/PVA_/S267K/L368D/K370S

SEQ ID NO: 1314 - protein, 451 aa, Artificial Sequence; identical to SEQ ID NO: 1101
  Description of Artificial Sequence: Synthetic polypeptide
  XENP33364 Chain 2 - mAb D[NKG2D]_H1_IgG1_PVA_/S267K/S364K/E357Q

SEQ ID NO: 1315 - protein, 214 aa, Artificial Sequence; identical to SEQ ID NO: 1102
  Description of Artificial Sequence: Synthetic polypeptide
  XENP33364 Chain 3- mAb D[NKG2D]_L1

SEQ ID NO: 1316 - protein, 435 aa, Artificial Sequence; identical to SEQ ID NO: 851
  Description of Artificial Sequence: Synthetic polypeptide
  XENP26007 Chain 1 - human_IL15Ra(sushi)_(GGGGS)5-human _IL15(N4D/N65D;single-Chain)_Fc(216)_IgG1_pI(-)_Isosteric_A _C220S/PVA_/S267K/L368D/K370S scIL-15/R-alpha-Fc Chain

SEQ ID NO: 1317 - protein, 449 aa, Artificial Sequence; identical to SEQ ID NO: 852
  Description of Artificial Sequence: Synthetic polypeptide
  XENP26007 Chain 2 - Numax_IgG1_PVA _/S267K/S364K/E357Q Heavy Chain

SEQ ID NO: 1318 - protein, 213 aa, Artificial Sequence; identical to SEQ ID NO: 848
  Description of Artificial Sequence: Synthetic polypeptide
  XENP26007 Chain 3 - Numax Light Chain

SEQ ID NO: 1319 - protein, 435 aa, Artificial Sequence; identical to SEQ ID NO: 914
  Description of Artificial Sequence: Synthetic polypeptide
  XENP30362 Chain 1 - human_IL15Ra(sushi)_(GGGGS)5-human_IL15 (N4D/N65D;single-Chain)_Fc(216)_IgG1_pI(-)_Isosteric_A_C220S /PVA_/S267K/L368D/K370S/M428L/N434S scIL-15/R-alpha-Fc Chain

SEQ ID NO: 1320 - protein, 449 aa, Artificial Sequence
  Description of Artificial Sequence: Synthetic polypeptide
  XENP30362 Chain 2 - Numax_IgG1_PVA _/S267K/S364K/E357Q/M428L/N434S Heavy Chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 1321 - protein, 213 aa, Artificial Sequence; identical to SEQ ID NO: 848
  Description of Artificial Sequence: Synthetic polypeptide
  XENP30362 Chain 3 - Numax Light Chain

SEQ ID NO: 1322 - protein, 435 aa, Artificial Sequence; identical to SEQ ID NO: 1237
  Description of Artificial Sequence: Synthetic polypeptide
  XENP29481 Chain 1 - human_IL15Ra(sushi)_(GGGGS)5-human _IL15(D30N/N65D;single-chain)_Fc(216)_IgG1_pI(-)_Isosteric_A _C220S/PVA_/S267K/L368D/K370S

SEQ ID NO: 1323 - protein, 449 aa, Artificial Sequence; identical to SEQ ID NO: 852
  Description of Artificial Sequence: Synthetic polypeptide
  XENP29481 Chain 2 - Numax_IgG1_PVA_/S267K/S364K/E357Q

SEQ ID NO: 1324 - protein, 213 aa, Artificial Sequence; identical to SEQ ID NO: 848
  Description of Artificial Sequence: Synthetic polypeptide
  XENP29481 Chain 3 - Numax LC

SEQ ID NO: 1325 - protein, 435 aa, Artificial Sequence; identical to SEQ ID NO: 1250
  Description of Artificial Sequence: Synthetic polypeptide
  XENP30363 Chain 1 - human_IL15Ra(sushi)_(GGGGS)5-human _IL15(D30N/N65D;single-chain)_Fc(216)_IgG1_pI(-)_Isosteric_A _C220S/PVA_/S267K/L368D/K370S/M428L/N434S

SEQ ID NO: 1326 - protein, 449 aa, Artificial Sequence; identical to SEQ ID NO: 1320
  Description of Artificial Sequence: Synthetic polypeptide
  XENP30363 Chain 2 - Numax_IgG1_PVA _/S267K/S364K/E357Q/M428L/N434S

SEQ ID NO: 1327 - protein, 213 aa, Artificial Sequence; identical to SEQ ID NO: 848
  Description of Artificial Sequence: Synthetic polypeptide
  XENP30363 Chain 3 - Numax LC

SEQ ID NO: 1328 - protein, 435 aa, Artificial Sequence; identical to SEQ ID NO: 1239
  Description of Artificial Sequence: Synthetic polypeptide
  XENP30432 Chain 1 - human_IL15Ra(sushi)_(GGGGS)5-human _IL15(D30N/E64Q/N65D;single-chain)_Fc(216)_IgG1_pI(-)_Isosteric _A_C220S/PVA_/S267K/L368D/K370S

SEQ ID NO: 1329 - protein, 449 aa, Artificial Sequence; identical to SEQ ID NO: 852
  Description of Artificial Sequence: Synthetic polypeptide
  XENP30432 Chain 2 - Numax_VH_IgG1_IgG1_PVA_/S267K/S364K/E357Q

SEQ ID NO: 1330 - protein, 213 aa, Artificial Sequence; identical to SEQ ID NO: 848
  Description of Artificial Sequence: Synthetic polypeptide
  XENP30432 Chain 3 - Numax LC

SEQ ID NO: 1331 - protein, 435 aa, Artificial Sequence; identical to SEQ ID NO: 1262
  Description of Artificial Sequence: Synthetic polypeptide
  XENP30518 Chain 1 - human_IL15Ra(sushi)_(GGGGS)5-human _IL15(D30N/E64Q/N65D;single-chain)_Fc(216)_IgG1_pI(-)_Isosteric _A_C220S/PVA_/S267K/L368D/K370S/M428L/N434S

SEQ ID NO: 1332 - protein, 449 aa, Artificial Sequence; identical to SEQ ID NO: 1320
  Description of Artificial Sequence: Synthetic polypeptide
  XENP30518 Chain 2 - Numax_VH_IgG1_IgG1_PVA _/S267K/S364K/E357Q/M428L/N434S

SEQ ID NO: 1333 - protein, 213 aa, Artificial Sequence; identical to SEQ ID NO: 848
  Description of Artificial Sequence: Synthetic polypeptide
  XENP30518 Chain 3 - Numax LC

What is claimed is:

1. A targeted heterodimeric protein comprising:
   a) a first monomer comprising, from N- to C-terminal:
      i) a human IL-15Rα(sushi) domain;
      ii) a first domain linker;
      iii) a variant of human IL-15 comprising the amino acid sequence of SEQ ID NO:2 and one or more amino acid substitutions selected from the group consisting of N1D, N4D, D8N, D30N, D61N, E64Q, N65D, and Q108E;
      iv) a second domain linker; and
      v) a first variant Fc domain; and
   b) a second monomer comprising, from N- to C-terminal:
      i) a NKG2D antigen binding domain (ABD); and
      ii) a second variant Fc domain,
   wherein said first Fc domain and said second Fc domain have a set of amino acid substitutions selected from the group consisting of: (i) S267K/L368D/K370S:S267K/S364K/E357Q; (ii) S364K/E357Q:L368D/K370S; (iii) L368D/K370S:S364K; (iv) L368E/K370S:S364K; (v) T411E/E360E/Q362E:D401K; (vi) L368D/K370S:S364K/E357Q, and (vii) K370S:S364K/E357Q, according to EU numbering; and
   wherein said NKG2D ABD comprises a variable heavy and light domain pair selected from the group consisting of MS[NKG2D]_H0L0 (variable domain of SEQ ID NO: 931 and variable domain of SEQ ID NO: 932), KYK-1.0[NKG2D]_H1L1 (SEQ ID NO: 1042 and SEQ ID NO: 1043), KYK-2.0[NKG2D]_H0L0 (SEQ ID NO: 1044 and 1045), 1D7B4[NKG2D]_H1L1 (SEQ ID NO: 1040 and SEQ ID NO: 1041), 6E5A7 [NKG2D]_H0L0 (SEQ ID NO: 1048 and SEQ ID NO: 1049), 6H7E7[NKG2D]_H0L0 (SEQ ID NO: 1050 and SEQ ID NO: 1051), 11B2D10[NKG2D]_H0L0 (SEQ ID NO: 1046 and SEQ ID NO: 1047), 16F31 [NKG2D]_H1L1 (SEQ ID NO: 1054 and SEQ ID NO: 1055), mAb A[NKG2D]_H1L1 (SEQ ID NO: 1060 and SEQ ID NO: 1062), mAb A[NKG2D]_H1L2 (SEQ ID NO: 1060 and SEQ ID NO: 1063), mAb A[NKG2D]_H2L1 (SEQ ID NO: 1061 and SEQ ID NO: 1062), mAb A[NKG2D]_H2L2 (SEQ ID NO: 1061 and SEQ ID NO: 1063), mAb B[NKG2D]_H1L1 (SEQ ID NO: 1064 and SEQ ID NO: 1067), mAb B[NKG2D]_H1L1.1 (SEQ ID NO: 1064 and SEQ ID NO: 1068), mAb B[NKG2D]_H1L2 (SEQ ID NO: 1064 and SEQ ID NO: 1069), mAb B[NKG2D]_H2L1 (SEQ ID NO: 1065 and SEQ ID NO: 1067), mAb B[NKG2D]_H2L1.1 (SEQ ID NO: 1065 and SEQ ID NO: 1068), mAb B[NKG2D]_H2L2 (SEQ ID NO: 1065 and SEQ ID NO: 1069), mAb B[NKG2D]_H3L1 (SEQ ID NO: 1066 and SEQ ID NO: 1067), mAb B[NKG2D]_H3L1.1 (SEQ ID NO: 1066 and SEQ ID NO: 1068), mAb B[NKG2D]_H3L2 (SEQ ID NO: 1066 and SEQ ID NO: 1069), mAb C[NKG2D]_H1L1 (SEQ ID NO: 1070 and SEQ ID NO: 1072), mAb C[NKG2D]_H1L2 (SEQ ID NO: 1070 and SEQ ID NO: 1073), mAb C[NKG2D]_H2L1 (SEQ ID NO: 1071 and SEQ ID NO: 1072), mAb C[NKG2D]_H2L2 (SEQ ID NO: 1071 and SEQ ID NO: 1073), mAb D[NKG2D]_H1L1 (SEQ ID NO: 1056 and SEQ ID NO: 1057), and mAb E[NKG2D]_H1L1 (SEQ ID NO: 1052 and SEQ ID NO: 1053).

2. The targeted heterodimeric protein of claim 1, wherein said variant of human IL-15 has amino acid substitutions selected from the group consisting of N4D/N65D, D30N/N65D, D30N/E64Q/N65D, N1D, N4D, D8N, D30N, D61N, E64Q, N65D, Q108E, N1D/D61N, N1D/E64Q, N4D, D61N, N4D/E64Q, D8N/D61N, D8N/E64Q, D61N/E64Q, E64Q/Q108E, N1D/N4D/D8N, D61N/E64Q/N65Q, N1D/D61N/E64Q/Q108E, N4D/D61N/E64Q/Q108E, N1D/N65D, D30N/Q108E, N65D/Q108E, E64Q/N65D, N1D/N4D/N65D, and N4D/D61N/N65D.

3. The targeted heterodimeric protein of claim 1, wherein said human IL-15Rα(sushi) domain comprises the amino acid sequence of SEQ ID NO:4.

4. The targeted heterodimeric protein of claim 1, wherein said NKG2D antigen binding domain is a single chain variable fragment (scFv) or a Fab fragment.

5. The targeted heterodimeric protein of claim 1, wherein said first or said second Fc domains have an additional amino acid substitution comprising Q295E/N384D/Q418E/N421D, according to EU numbering.

6. The targeted heterodimeric protein of claim 1, wherein said first and said second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

7. The targeted heterodimeric protein of claim 1, wherein said first and said second Fc domains have an additional set of amino acid substitutions M428L/N434S.

* * * * *